United States Patent 12,442,020 (MATERIALS AND METHODS FOR TREATMENT OF PAIN RELATED DISORDERS) - sequence listing, part 5

SEQ ID NO: 49563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttttctttataaattacc

SEQ ID NO: 49564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttataaattacccagtct

SEQ ID NO: 49565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttataaattacccagtctc

SEQ ID NO: 49566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaattacccagtctcagg

SEQ ID NO: 49567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtctcaggtagttcttta

SEQ ID NO: 49568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcaggtagttctttatag

SEQ ID NO: 49569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttatagcagtgtaaaaa

SEQ ID NO: 49570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agtgtaaaaatggactaata

SEQ ID NO: 49571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaaaatggactaatacggc

SEQ ID NO: 49572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaatggactaatacggcc

SEQ ID NO: 49573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggactaatacggccgggcg

SEQ ID NO: 49574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actaatacggccgggcgtgg

SEQ ID NO: 49575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctgtgttcc

SEQ ID NO: 49576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctgtgttcccagcactt

SEQ ID NO: 49577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtgttcccagcacttt

SEQ ID NO: 49578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtgttcccagcactttgg

SEQ ID NO: 49579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgttcccagcactttggg

SEQ ID NO: 49580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccagcactttgggaggcc

SEQ ID NO: 49581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttgggaggcca

SEQ ID NO: 49582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcactttgggaggccaagg

SEQ ID NO: 49583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttgggaggccaaggt

SEQ ID NO: 49584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgggaggccaaggtggg

SEQ ID NO: 49585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggtgggcagaacacaacgt

SEQ ID NO: 49586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtgggcagaacacaacgtc

SEQ ID NO: 49587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggcagaacacaacgtcag

SEQ ID NO: 49588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacacaacgtcaggagatc

SEQ ID NO: 49589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagatcgagaccatcc

SEQ ID NO: 49590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cgagaccatcctggctaaca

SEQ ID NO: 49591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaatacaaaaacaaaat

SEQ ID NO: 49592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatacaaaaacaaaattagc

SEQ ID NO: 49593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atacaaaaacaaaattagcc

SEQ ID NO: 49594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaacaaaattagccaggtg

SEQ ID NO: 49595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattagccaggtgtgg

SEQ ID NO: 49596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaattagccaggtgtggtgg

SEQ ID NO: 49597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattagccaggtgtggtggc

SEQ ID NO: 49598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtgtggtggcgggtacctg

SEQ ID NO: 49599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcgggtacctgtagtcc

SEQ ID NO: 49600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctgtagtcccagctaccc

SEQ ID NO: 49601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtagtcccagctaccctg

SEQ ID NO: 49602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagtcccagctaccctgg

SEQ ID NO: 49603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctaccctggaggct

SEQ ID NO: 49604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctaccctggaggctg

SEQ ID NO: 49605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctaccctggaggctgagg

SEQ ID NO: 49606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctaccctggaggctgaggt

SEQ ID NO: 49607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccctggaggctgaggtgg

SEQ ID NO: 49608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggaggctgaggtgggagaa

SEQ ID NO: 49609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtgggagaatggcgtgaacc

SEQ ID NO: 49610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggagaatggcgtgaaccc

SEQ ID NO: 49611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatggcgtgaacccgg

SEQ ID NO: 49612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaatggcgtgaacccggg

SEQ ID NO: 49613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatggcgtgaacccgggagg

SEQ ID NO: 49614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggcgtgaacccgggaggcg

SEQ ID NO: 49615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccgggaggcggagcttg

SEQ ID NO: 49616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggaggcggagcttgcagt

SEQ ID NO: 49617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agtgagccaaaatcgcgcca

SEQ ID NO: 49618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaatcgcgccacggcactc

SEQ ID NO: 49619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcgccacggcactccagcc

SEQ ID NO: 49620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcgccacggcactccagcct

SEQ ID NO: 49621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggcactccagcctgggcaa

SEQ ID NO: 49622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgggcaaca

SEQ ID NO: 49623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactccagcctgggcaacag

SEQ ID NO: 49624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actccagcctgggcaacaga

SEQ ID NO: 49625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagcctgggcaacagagg

SEQ ID NO: 49626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaaaaaaaaaaaaaaaa

SEQ ID NO: 49627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaagactaatacatgta

SEQ ID NO: 49628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagactaatacatgtatagt

SEQ ID NO: 49629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtcagaaactatatcataa

SEQ ID NO: 49630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcagaaactatatcataac

SEQ ID NO: 49631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcataacaggtaatgaa

SEQ ID NO: 49632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcataacaggtaatgaaa

SEQ ID NO: 49633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcataacaggtaatgaaaag

SEQ ID NO: 49634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaggagtttgaacaaaaat

SEQ ID NO: 49635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggagtttgaacaaaaata

SEQ ID NO: 49636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgaacaaaaataaggcat

SEQ ID NO: 49637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggcatgagttttgtattc

SEQ ID NO: 49638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggcatgagttttgtattca

SEQ ID NO: 49639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtattcaaggaacttcc

SEQ ID NO: 49640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacttcctagaaaaatgaa

SEQ ID NO: 49641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcctagaaaaatgaaaag

SEQ ID NO: 49642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagaaaaatgaaaagaaga

SEQ ID NO: 49643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaagaaagtaactaatat

SEQ ID NO: 49644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaagaaagtaactaatata

SEQ ID NO: 49645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagtaactaatataaggc

SEQ ID NO: 49646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatataaggcaagatgtga

SEQ ID NO: 49647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatgtgacagatatcata

SEQ ID NO: 49648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcatacagaaaaatata

SEQ ID NO: 49649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcatacagaaaaatataa

SEQ ID NO: 49650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcatacagaaaaatataaa

SEQ ID NO: 49651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcatacagaaaaatataaag

SEQ ID NO: 49652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catacagaaaaatataaagg

SEQ ID NO: 49653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagaaaaatataaaggggg

SEQ ID NO: 49654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatataaagggggaagaat

SEQ ID NO: 49655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atataaagggggaagaatga

SEQ ID NO: 49656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagggggaagaatgagagtg

SEQ ID NO: 49657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggggaagaatgagagtgaa

SEQ ID NO: 49658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggaagaatgagagtgaag

SEQ ID NO: 49659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggaagaatgagagtgaaga

SEQ ID NO: 49660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatgagagtgaagagggaa

SEQ ID NO: 49661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgagagtgaagagggaac

SEQ ID NO: 49662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgagagtgaagagggaaca

SEQ ID NO: 49663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacatgactgtcaaaattat

SEQ ID NO: 49664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatgactgtcaaaattatc

SEQ ID NO: 49665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catgactgtcaaaattatca

SEQ ID NO: 49666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgactgtcaaaattatcagg

SEQ ID NO: 49667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atcagggagactttataaac

SEQ ID NO: 49668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagggagactttataaaccg

SEQ ID NO: 49669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggagactttataaaccgg

SEQ ID NO: 49670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttataaaccggaggtcatct

SEQ ID NO: 49671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatcacaacatactaca

SEQ ID NO: 49672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaacatactacatagtat

SEQ ID NO: 49673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatactacatagtattggc

SEQ ID NO: 49674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacatagtattggcaagatc

SEQ ID NO: 49675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacttgaaattttaataaa

SEQ ID NO: 49676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attttaataaaaagaattgt

SEQ ID NO: 49677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggtattttaaaattgaaat

SEQ ID NO: 49678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctcattaaaaactttt

SEQ ID NO: 49679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaacttttaagtgatttt

SEQ ID NO: 49680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaacttttaagtgattttt

SEQ ID NO: 49681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttgggtctgcatacacat

SEQ ID NO: 49682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgggtctgcatacacatga

SEQ ID NO: 49683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacacatgagagttaattat

SEQ ID NO: 49684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatgagagttaattattag

SEQ ID NO: 49685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgagagttaattattagc

SEQ ID NO: 49686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattattagcaggaaaaaa

SEQ ID NO: 49687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattattagcaggaaaaaat

SEQ ID NO: 49688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataggtatgattataaaatt

SEQ ID NO: 49689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtatgattataaaatttgg

SEQ ID NO: 49690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatttcacaattgcttca

SEQ ID NO: 49691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttcacaattgcttcaaa

SEQ ID NO: 49692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcaaagagaataaaatacc

SEQ ID NO: 49693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaagagaataaaatacct

SEQ ID NO: 49694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacctaggaatccaacttac

SEQ ID NO: 49695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctaggaatccaacttaca

SEQ ID NO: 49696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctaggaatccaacttacaa

SEQ ID NO: 49697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaacttacaagggatgtg

SEQ ID NO: 49698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaacttacaagggatgtga

SEQ ID NO: 49699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggatgtgaaggacctcttc

SEQ ID NO: 49700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggatgtgaaggacctcttcg

SEQ ID NO: 49701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtgaaggacctcttcgag

SEQ ID NO: 49702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaactacaaaccactgctc

SEQ ID NO: 49703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaactacaaaccactgctca

SEQ ID NO: 49704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accactgctcaaggaaataa

SEQ ID NO: 49705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactgctcaaggaaataaaa

SEQ ID NO: 49706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgctcaaggaaataaaag

SEQ ID NO: 49707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaagaggatacaaacaaa

SEQ ID NO: 49708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaggatacaaacaaatgg

SEQ ID NO: 49709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaacattccatgctcatgtg

SEQ ID NO: 49710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacattccatgctcatgtgt

SEQ ID NO: 49711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attccatgctcatgtgtagg

SEQ ID NO: 49712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaatcaatatcgtgaaaa

SEQ ID NO: 49713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaatggccatactgccc

SEQ ID NO: 49714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaatggccatactgccca

SEQ ID NO: 49715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atactgcccaaggtaattta

SEQ ID NO: 49716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattcaatgccatccccatc

SEQ ID NO: 49717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctaccaatgactttcttca

SEQ ID NO: 49718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgactttcttcacagaac

SEQ ID NO: 49719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactggaaaaaactacttta

SEQ ID NO: 49720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactactttaaagttcata

SEQ ID NO: 49721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttcatatggaaccaaaa

SEQ ID NO: 49722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcatatggaaccaaaaaa

SEQ ID NO: 49723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaagagcccgcatcgcc

SEQ ID NO: 49724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgcatcgccaagtcaatcct

SEQ ID NO: 49725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaagtcaatcctaagccaa

SEQ ID NO: 49726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcctaagccaaaagaaca

SEQ ID NO: 49727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaagccaaaagaacaaagc

SEQ ID NO: 49728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagccaaaagaacaaagctg

SEQ ID NO: 49729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agccaaaagaacaaagctgg

SEQ ID NO: 49730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgacttcaaactacactac

SEQ ID NO: 49731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacttcaaactacactaca

SEQ ID NO: 49732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaactacactacaaggcta

SEQ ID NO: 49733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaggctacagtaacccaaa

SEQ ID NO: 49734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctacagtaacccaaacagca

SEQ ID NO: 49735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacccaaacagcatggtac

SEQ ID NO: 49736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatggtactggtaccaaaa

SEQ ID NO: 49737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggtactggtaccaaaaca

SEQ ID NO: 49738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctggtaccaaaacagagata

SEQ ID NO: 49739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaacagagatatagatcaa

SEQ ID NO: 49740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagatatagatcaatggaa

SEQ ID NO: 49741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatagatcaatggaacagaa

SEQ ID NO: 49742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagatcaatggaacagaaca

SEQ ID NO: 49743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggaacagaacagagccct

SEQ ID NO: 49744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atctgatctttgacaaacct

SEQ ID NO: 49745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgacaaacctgagaaaaac

SEQ ID NO: 49746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacctgagaaaaacaagcaa

SEQ ID NO: 49747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acctgagaaaaacaagcaat

SEQ ID NO: 49748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctgagaaaaacaagcaatg

SEQ ID NO: 49749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaaacaagcaatgggga

SEQ ID NO: 49750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaaacaagcaatggggaa

SEQ ID NO: 49751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggattccctatttaacaaa

SEQ ID NO: 49752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctatttaacaaatggtgc

SEQ ID NO: 49753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctatttaacaaatggtgct

SEQ ID NO: 49754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaatggtgctgggaaaac

SEQ ID NO: 49755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggtgctgggaaaactggc

SEQ ID NO: 49756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaactggctagccatatg

SEQ ID NO: 49757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actggctagccatatgtaga

SEQ ID NO: 49758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catatgtagaaagctgaaac

SEQ ID NO: 49759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttatacaaaaatcaattc

SEQ ID NO: 49760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacaaaaatcaattcaaga

SEQ ID NO: 49761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcaattcaagatggatta

SEQ ID NO: 49762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggattaaagacttaaacat

SEQ ID NO: 49763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctaaaaccataaaaaccc

SEQ ID NO: 49764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaccataaaaaccctag

SEQ ID NO: 49765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaccctagaagaaaacc

SEQ ID NO: 49766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaccctagaagaaaaccc

SEQ ID NO: 49767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacccaggcattaccatt

SEQ ID NO: 49768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacccaggcattaccattc

SEQ ID NO: 49769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcattaccattcaggaca

SEQ ID NO: 49770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcattaccattcaggacat

SEQ ID NO: 49771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taccattcaggacataggca

SEQ ID NO: 49772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accattcaggacataggcat

SEQ ID NO: 49773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaggacataggcatgggc

SEQ ID NO: 49774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaggacataggcatgggca

SEQ ID NO: 49775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcatgtctaaaacaccaa

SEQ ID NO: 49776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctaaaacaccaaaagcaa

SEQ ID NO: 49777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaaaagcaatggcaacaa

SEQ ID NO: 49778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaagacaaaattgacaaa

SEQ ID NO: 49779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaagacaaaattgacaaat

SEQ ID NO: 49780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgggatctaattaaacta

SEQ ID NO: 49781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggatctaattaaactaaa

SEQ ID NO: 49782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaactaaagagcttctgca

SEQ ID NO: 49783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcaaaataaactaccat

SEQ ID NO: 49784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaaaataaactaccatca

SEQ ID NO: 49785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaacatgcaacctacaaaa

SEQ ID NO: 49786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacatgcaacctacaaaat

SEQ ID NO: 49787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acatgcaacctacaaaatgg

SEQ ID NO: 49788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaacctactcatctgacaa

SEQ ID NO: 49789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacctactcatctgacaaa

SEQ ID NO: 49790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgacaaaaggctaatatc

SEQ ID NO: 49791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaactcaaacaaatttac

SEQ ID NO: 49792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaaacaaccccatcaaa

SEQ ID NO: 49793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaacaaccccatcaaaaag

SEQ ID NO: 49794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaaccccatcaaaaagt

SEQ ID NO: 49795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accccatcaaaaagtgggca

SEQ ID NO: 49796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccatcaaaaagtgggcaa

SEQ ID NO: 49797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtgggcaaaggacatgaa

SEQ ID NO: 49798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgaacagacacttctcaa

SEQ ID NO: 49799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacagacacttctcaaaag

SEQ ID NO: 49800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaaaagaagacatttatg

SEQ ID NO: 49801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaaatgctcatcatcac

SEQ ID NO: 49802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctcatcatcactggccat

SEQ ID NO: 49803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcatcatcactggccatca

SEQ ID NO: 49804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcaaatcaaaaccacaat

SEQ ID NO: 49805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgagataccatctcacac

SEQ ID NO: 49806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agataccatctcacaccagt

SEQ ID NO: 49807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatctcacaccagttagaa

SEQ ID NO: 49808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaatggcaatcattaaa

SEQ ID NO: 49809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggcaatcattaaaaagt

SEQ ID NO: 49810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggcaatcattaaaaagtc

SEQ ID NO: 49811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaaaaagtcaggaaacaa

SEQ ID NO: 49812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaaagtcaggaaacaac

SEQ ID NO: 49813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcaggaaacaacaggtgc

SEQ ID NO: 49814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaggaaacaacaggtgctg

SEQ ID NO: 49815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaaacaacaggtgctgga

SEQ ID NO: 49816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaacaacaggtgctggag

SEQ ID NO: 49817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaggtgctggagaggatg

SEQ ID NO: 49818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggtgctggagaggatgtg

SEQ ID NO: 49819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctggagaggatgtggagaaa

SEQ ID NO: 49820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggagaggatgtggagaaat

SEQ ID NO: 49821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taggaacacttttacactgt

SEQ ID NO: 49822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaacacttttacactgttgg

SEQ ID NO: 49823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacactgttggtggtaaac

SEQ ID NO: 49824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaactagttcaaccattg

SEQ ID NO: 49825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactagttcaaccattgtgg

SEQ ID NO: 49826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttcaaccattgtggaagt

SEQ ID NO: 49827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccattgtggaagtcagtg

SEQ ID NO: 49828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtcagtgtggcgattcct

SEQ ID NO: 49829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcagtgtggcgattcctc

SEQ ID NO: 49830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtcagtgtggcgattcctca

SEQ ID NO: 49831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggcgattcctcagggatc

SEQ ID NO: 49832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcctcagggatctagaac

SEQ ID NO: 49833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actagaaataccatttgacc

SEQ ID NO: 49834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgacccagccatcccattac

SEQ ID NO: 49835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacccagccatcccattact

SEQ ID NO: 49836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattactgggtatataccca

SEQ ID NO: 49837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attactgggtatatacccaa

SEQ ID NO: 49838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctataaatcatgctgctata

SEQ ID NO: 49839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcacacatatgtttattg

SEQ ID NO: 49840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattgtggcattattcacaa

SEQ ID NO: 49841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattcacaatagcaaacact

SEQ ID NO: 49842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acccaaatgtccaacaatga

SEQ ID NO: 49843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtccaacaatgatagac

SEQ ID NO: 49844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacaatgatagactggatt

SEQ ID NO: 49845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagactggattaagaaaatg

SEQ ID NO: 49846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtggctcatatacacca

SEQ ID NO: 49847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacaccatggaatactatg

SEQ ID NO: 49848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcagccataaaaaatgat

SEQ ID NO: 49849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatgagttcacgtcctttg

SEQ ID NO: 49850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgagttcacgtcctttgt

SEQ ID NO: 49851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgagttcacgtcctttgta

SEQ ID NO: 49852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacgtcctttgtagggaca

SEQ ID NO: 49853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtagggacatggatgcaat

SEQ ID NO: 49854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattggaaatcatcattct

SEQ ID NO: 49855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctcagtaaactatcac

SEQ ID NO: 49856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaccgcatattctcactca

SEQ ID NO: 49857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caccgcatattctcactcat

SEQ ID NO: 49858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcatattctcactcatagg

SEQ ID NO: 49859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcatattctcactcataggt

SEQ ID NO: 49860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattgaacaatgaaatcaca

SEQ ID NO: 49861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaatgaaatcacatggaca

SEQ ID NO: 49862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatgaaatcacatggacac

SEQ ID NO: 49863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaatcacatggacacagg

SEQ ID NO: 49864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatcacatggacacagga

SEQ ID NO: 49865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatcacatggacacaggaa

SEQ ID NO: 49866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcacatggacacaggaag

SEQ ID NO: 49867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaaggggaatatcacactc

SEQ ID NO: 49868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaggggaatatcacactct

SEQ ID NO: 49869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggggaatatcacactcta

SEQ ID NO: 49870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatcacactctagggactg

SEQ ID NO: 49871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacactctagggactgtgg

SEQ ID NO: 49872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacactctagggactgtggt

SEQ ID NO: 49873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acactctagggactgtggtg

SEQ ID NO: 49874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctagggactgtggtgggg

SEQ ID NO: 49875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctagggactgtggtggggt

SEQ ID NO: 49876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctagggactgtggtggggtg

SEQ ID NO: 49877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagggactgtggtggggtgg

SEQ ID NO: 49878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggactgtggtggggtggg

SEQ ID NO: 49879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggactgtggtggggtggggg

SEQ ID NO: 49880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactgtggtggggtgggggg

SEQ ID NO: 49881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actgtggtggggtgggggga

SEQ ID NO: 49882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgtggtggggtggggggag

SEQ ID NO: 49883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtggtggggtggggggagg

SEQ ID NO: 49884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtggtggggtggggggaggg

SEQ ID NO: 49885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtggggtggggggaggggg

SEQ ID NO: 49886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtggggtggggggagggggg

SEQ ID NO: 49887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggggtggggggagggggga

SEQ ID NO: 49888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggggggaggggggaggga

SEQ ID NO: 49889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaggggggagggatagcat

SEQ ID NO: 49890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaggggggagggatagcatt

SEQ ID NO: 49891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggggggagggatagcattgg

SEQ ID NO: 49892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgggagatatacctaatgc

SEQ ID NO: 49893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatacctaatgctagatgac

SEQ ID NO: 49894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctaatgctagatgaccagt

SEQ ID NO: 49895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgctagatgaccagttag

SEQ ID NO: 49896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgctagatgaccagttagt

SEQ ID NO: 49897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgaccagttagtgggtg

SEQ ID NO: 49898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttagtgggtgcagcgcac

SEQ ID NO: 49899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgggtgcagcgcaccagca

SEQ ID NO: 49900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgtaccctaaaactta

SEQ ID NO: 49901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattaaaaaaaaaaattaa

SEQ ID NO: 49902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaaaaaaaaattaaaag

SEQ ID NO: 49903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaagtagtatgccaatgc

SEQ ID NO: 49904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagtagtatgccaatgcca

SEQ ID NO: 49905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcaatgaaaaatttgaaa

SEQ ID NO: 49906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaaaaatttgaaaaagta

SEQ ID NO: 49907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatatttaatttaacattc

SEQ ID NO: 49908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaacattctggtcatgata

SEQ ID NO: 49909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttaaaataatttttata

SEQ ID NO: 49910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaataatttttatacag

SEQ ID NO: 49911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaataatttttatacaga

SEQ ID NO: 49912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataatttttatacagaagg

SEQ ID NO: 49913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttatacagaaggaagccaa

SEQ ID NO: 49914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaacagaaactgaccactg

SEQ ID NO: 49915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactcacctttttgtctgca

SEQ ID NO: 49916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacctttttgtctgcatag

SEQ ID NO: 49917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacctttttgtctgcatagt

SEQ ID NO: 49918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acctttttgtctgcatagta

SEQ ID NO: 49919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctttttgtctgcatagtag

SEQ ID NO: 49920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtctgcatagtaggggtcc

SEQ ID NO: 49921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtaggggtccaagtcctc

SEQ ID NO: 49922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtaggggtccaagtcctcc

SEQ ID NO: 49923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaggggtccaagtcctcca

SEQ ID NO: 49924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggggtccaagtcctccag

SEQ ID NO: 49925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggggctctgacaccatgc

SEQ ID NO: 49926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggggctctgacaccatgcc

SEQ ID NO: 49927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggctctgacaccatgccgg

SEQ ID NO: 49928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggctctgacaccatgccggg

SEQ ID NO: 49929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgccgggaggaatgtcccca

SEQ ID NO: 49930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggaatgtccccatagatg

SEQ ID NO: 49931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggaatgtccccatagatga

SEQ ID NO: 49932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaatgtccccatagatgaa

SEQ ID NO: 49933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtccccatagatgaaggg

SEQ ID NO: 49934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgaagggcagctgtttgc

SEQ ID NO: 49935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagctgtttgccagcttcc

SEQ ID NO: 49936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagcttccaagtcactgct

SEQ ID NO: 49937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccaagtcactgcttggctt

SEQ ID NO: 49938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaagtcactgcttggcttt

SEQ ID NO: 49939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caagtcactgcttggctttg

SEQ ID NO: 49940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcatctttcttttcttctt

SEQ ID NO: 49941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcatctttcttttcttcttt

SEQ ID NO: 49942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggttcctttgattttcttt

SEQ ID NO: 49943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagcaatgcgttgttcaat

SEQ ID NO: 49944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagcaatgcgttgttcaatg

SEQ ID NO: 49945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcaatgcgttgttcaatga

SEQ ID NO: 49946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcgttgttcaatgagggc

SEQ ID NO: 49947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcgttgttcaatgagggcaa

SEQ ID NO: 49948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagagactgttttgtgaaa

SEQ ID NO: 49949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgttttgtgaaatggaca

SEQ ID NO: 49950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgaaatggacaaagctct

SEQ ID NO: 49951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgaaatggacaaagctctg

SEQ ID NO: 49952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggacaaagctctgaggtcc

SEQ ID NO: 49953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggacaaagctctgaggtcct

SEQ ID NO: 49954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacaaagctctgaggtcctg

SEQ ID NO: 49955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaagctctgaggtcctgg

SEQ ID NO: 49956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagctctgaggtcctgggg

SEQ ID NO: 49957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagctctgaggtcctggggg

SEQ ID NO: 49958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtatattttaattcctctt

SEQ ID NO: 49959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctcttcagctcctcacat

SEQ ID NO: 49960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcttcagctcctcacataa

SEQ ID NO: 49961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttcagctcctcacataag

SEQ ID NO: 49962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctcctcacataagaggcc

SEQ ID NO: 49963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctcacataagaggcctgga

SEQ ID NO: 49964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaggcctggatggaaaca

SEQ ID NO: 49965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggatggaaacaaagaaata

SEQ ID NO: 49966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacttaactatttgcctgcc

SEQ ID NO: 49967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taactatttgcctgccaaga

SEQ ID NO: 49968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactatttgcctgccaagaa

SEQ ID NO: 49969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaataataacaacataaa

SEQ ID NO: 49970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taacaacataaacagatttt

SEQ ID NO: 49971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttttagtttcaactacaa

SEQ ID NO: 49972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttagtttcaactacaaa

SEQ ID NO: 49973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctacaaaaggtaacatgttc

SEQ ID NO: 49974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaacatgttctagaattat

SEQ ID NO: 49975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctagaattatcagcttgtt

SEQ ID NO: 49976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagaattatcagcttgtta

SEQ ID NO: 49977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagaattatcagcttgttaa

SEQ ID NO: 49978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaagggattactatgtgt

SEQ ID NO: 49979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaagggattactatgtgtc

SEQ ID NO: 49980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattactatgtgtcaggcaa

SEQ ID NO: 49981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attactatgtgtcaggcaat

SEQ ID NO: 49982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
actatgtgtcaggcaatggg

SEQ ID NO: 49983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctatgtgtcaggcaatgggc

SEQ ID NO: 49984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttctaaccatctttatact

SEQ ID NO: 49985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctttatactcagaaatttg

SEQ ID NO: 49986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttgaagtttacgcttca

SEQ ID NO: 49987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttacgcttcatagcttta

SEQ ID NO: 49988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaaaaaatgacaattttct

SEQ ID NO: 49989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttcgtctatatttacctt

SEQ ID NO: 49990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcaactttcctcttttaa

SEQ ID NO: 49991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtctttatgataatgcctt

SEQ ID NO: 49992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttatgataatgcctttgg

SEQ ID NO: 49993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctttggtagcaccactctc

SEQ ID NO: 49994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgttcataacatcttgac

SEQ ID NO: 49995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgttcataacatcttgacc

SEQ ID NO: 49996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcataacatcttgaccag

SEQ ID NO: 49997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cataacatcttgaccaggag

SEQ ID NO: 49998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactttctttgcttatcaat

SEQ ID NO: 49999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctttgcttatcaatcag

SEQ ID NO: 50000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcaactcctcatccattc

SEQ ID NO: 50001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatccattcaagttaccgc

SEQ ID NO: 50002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccattcaagttaccgcgaga

SEQ ID NO: 50003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagttaccgcgagatgg

SEQ ID NO: 50004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accgcgagatggcagcaatt

SEQ ID NO: 50005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcaattcagtcacaattt

SEQ ID NO: 50006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcaattcagtcacaatttt

SEQ ID NO: 50007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctatttccaccacatctg

SEQ ID NO: 50008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcagttctttccatcactg

SEQ ID NO: 50009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgaagtcttaaacctctca

SEQ ID NO: 50010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacctctcatagtcatccat

SEQ ID NO: 50011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctctcatagtcatccatga

SEQ ID NO: 50012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatagtcatccatgagagt

SEQ ID NO: 50013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaatgttctaataacatc

SEQ ID NO: 50014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttctaataacatctagaa

SEQ ID NO: 50015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctagaatggtgaatcctttc

SEQ ID NO: 50016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatggtgaatcctttccag

SEQ ID NO: 50017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattttcaatttacttttcc

SEQ ID NO: 50018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttacttttcccagacccat

SEQ ID NO: 50019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttttcccagacccatca

SEQ ID NO: 50020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttttcccagacccatcag

SEQ ID NO: 50021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcagaggaatcactatcta

SEQ ID NO: 50022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaggaatcactatctatgg

SEQ ID NO: 50023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcactatctatggcagcta

SEQ ID NO: 50024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgtatttattaaaaaat

SEQ ID NO: 50025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattaaaaaataagacttaa

SEQ ID NO: 50026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaagttgaaattactctt

SEQ ID NO: 50027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaattactctttggccca

SEQ ID NO: 50028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaattactctttggcccat

SEQ ID NO: 50029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actctttggcccataggcta

SEQ ID NO: 50030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggcccataggctacagaa

SEQ ID NO: 50031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccataggctacagaatgga

SEQ ID NO: 50032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctacagaatggatagcgt

SEQ ID NO: 50033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacagaatggatagcgttag

SEQ ID NO: 50034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagaatggatagcgttagc

SEQ ID NO: 50035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgcccttgtacctctccgt

SEQ ID NO: 50036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcccttgtacctctccgtta

SEQ ID NO: 50037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctctccgttagagctctt

SEQ ID NO: 50038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgttagagctcttgagtgac

SEQ ID NO: 50039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttagagctcttgagtgacc

SEQ ID NO: 50040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgaccaggcacattgtcaa

SEQ ID NO: 50041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaccaggcacattgtcaat

SEQ ID NO: 50042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaggcacattgtcaatagg

SEQ ID NO: 50043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataggcagtgatattttga

SEQ ID NO: 50044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatcttttttttttttcct

SEQ ID NO: 50045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttttttcctgagctat

SEQ ID NO: 50046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagctataagtatcaacac

SEQ ID NO: 50047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagctataagtatcaacact

SEQ ID NO: 50048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacactgggcctaaaatatt

SEQ ID NO: 50049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttagtgaaccatgctgtaaa

SEQ ID NO: 50050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaacagacgtgctgtcatc

SEQ ID NO: 50051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacagacgtgctgtcatcc

SEQ ID NO: 50052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggctttgttgttctattta

SEQ ID NO: 50053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctttgttgttctatttata

SEQ ID NO: 50054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttgttctatttatagagca

SEQ ID NO: 50055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgttctatttatagagcac

SEQ ID NO: 50056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctatttatagagcacagg

SEQ ID NO: 50057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatttatagagcacaggca

SEQ ID NO: 50058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttatagagcacaggcagag

SEQ ID NO: 50059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagcacaggcagagtagatt

SEQ ID NO: 50060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtagatttagtataattctt

SEQ ID NO: 50061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatttagtataattcttaa

SEQ ID NO: 50062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgaataattaaataata

SEQ ID NO: 50063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattatttaattttctgaa

SEQ ID NO: 50064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttaattttctgaatagta

SEQ ID NO: 50065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattatttaattttctgaa

SEQ ID NO: 50066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattatgtaattttctgaa

SEQ ID NO: 50067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattatgtaattttctgaa

SEQ ID NO: 50068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattaaataatataattct

SEQ ID NO: 50069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agattttctgaacgataaat

SEQ ID NO: 50070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagcatttgcttcaattta

SEQ ID NO: 50071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgcttcaatttaaagtcac

SEQ ID NO: 50072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagctgcattatcccctaac

SEQ ID NO: 50073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctgcattatcccctaacaa

SEQ ID NO: 50074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcattatcccctaacaaga

SEQ ID NO: 50075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatcccctaacaagagagt

SEQ ID NO: 50076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagagtcagcctgttcgttg

SEQ ID NO: 50077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcctgttcgttgaagctttg

SEQ ID NO: 50078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcgttgaagctttgaagc

SEQ ID NO: 50079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacattgacttctcctttc

SEQ ID NO: 50080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctagctataatatattcttc

SEQ ID NO: 50081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctataatatattcttctag

SEQ ID NO: 50082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatatattcttctagtag

SEQ ID NO: 50083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatatattcttctagtaga

SEQ ID NO: 50084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcttctagtagaaggctgt

SEQ ID NO: 50085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accactcttatcaatgatct

SEQ ID NO: 50086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcttatcaatgatcttagc

SEQ ID NO: 50087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttgctgcatcttctccat

SEQ ID NO: 50088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caccttgcatttttatgtta

SEQ ID NO: 50089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgcatttttatgttatgg

SEQ ID NO: 50090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttctttccttcaatctca

SEQ ID NO: 50091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttctttccttcaatctcat

SEQ ID NO: 50092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctttccttcaatctcatg

SEQ ID NO: 50093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcatggggtaccgtctgc

SEQ ID NO: 50094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcttcaaaccttttttttc

SEQ ID NO: 50095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttccagcttcttcacctct

SEQ ID NO: 50096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctctcagccttcatacaat

SEQ ID NO: 50097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcagccttcatacaattg

SEQ ID NO: 50098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttcatacaattggagtta

SEQ ID NO: 50099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggagttatggccttgctg

SEQ ID NO: 50100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttatggccttgctgtggat

SEQ ID NO: 50101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatggccttgctgtggatt

SEQ ID NO: 50102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttgctgtggattaggctt

SEQ ID NO: 50103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtggattaggctttggctt

SEQ ID NO: 50104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtggattaggctttggctta

SEQ ID NO: 50105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttggcttaaggaaatgttg

SEQ ID NO: 50106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcttaaggaaatgttgtggc

SEQ ID NO: 50107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggctggttgatcttctatc

SEQ ID NO: 50108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actttctctatatttgcaat

SEQ ID NO: 50109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttctctatatttgcaata

SEQ ID NO: 50110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttatcattcatgtgttcac

SEQ ID NO: 50111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcattcatgtgttcactg

SEQ ID NO: 50112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattcatgtgttcactggag

SEQ ID NO: 50113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcacatttgatttccttc

SEQ ID NO: 50114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcctttgcattcacaact

SEQ ID NO: 50115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgcattcacaacttggct

SEQ ID NO: 50116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacaacttggctaagtact

SEQ ID NO: 50117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttggctaagtacttagtgc

SEQ ID NO: 50118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggctaagtacttagtgcaa

SEQ ID NO: 50119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggctaagtacttagtgcaag

SEQ ID NO: 50120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtacttagtgcaagaggcc

SEQ ID NO: 50121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgcaagaggcctagattt

SEQ ID NO: 50122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctagattttggcctatct

SEQ ID NO: 50123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaacatgccttcctcact

SEQ ID NO: 50124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcactaagcttaatcatttc

SEQ ID NO: 50125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttctagcttctgattta

SEQ ID NO: 50126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctagcttctgatttaaagt

SEQ ID NO: 50127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcttcctttacttgaacat

SEQ ID NO: 50128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttcctttacttgaacatt

SEQ ID NO: 50129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttcctttacttgaacatta

SEQ ID NO: 50130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcctttacttgaacattag

SEQ ID NO: 50131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttacttgaacattagggg

SEQ ID NO: 50132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttacttgaacattaggggt

SEQ ID NO: 50133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaacattaggggtgggaa

SEQ ID NO: 50134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaacattaggggtgggaat

SEQ ID NO: 50135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtgggaatgggttactaat

SEQ ID NO: 50136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attttaacatcgttgtgtgt

SEQ ID NO: 50137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttaacatcgttgtgtgtc

SEQ ID NO: 50138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttaacatcgttgtgtgtca

SEQ ID NO: 50139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catcgttgtgtgtcagggaa

SEQ ID NO: 50140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcgttgtgtgtcagggaac

SEQ ID NO: 50141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcgttgtgtgtcagggaaca

SEQ ID NO: 50142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtgtgtcagggaacaggg

SEQ ID NO: 50143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcagggaacagggaagcct

SEQ ID NO: 50144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcagggaacagggaagcctg

SEQ ID NO: 50145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaacagggaagcctgagga

SEQ ID NO: 50146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaacagggaagcctgaggaa

SEQ ID NO: 50147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacagggaagcctgaggaaa

SEQ ID NO: 50148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagggaagcctgaggaaagg

SEQ ID NO: 50149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggaagcctgaggaaaggga

SEQ ID NO: 50150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagcctgaggaaagggaga

SEQ ID NO: 50151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgaggaaagggagagaga

SEQ ID NO: 50152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgaggaaagggagagagat

SEQ ID NO: 50153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaggaaagggagagagata

SEQ ID NO: 50154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagagatagggatgctgaaa

SEQ ID NO: 50155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgattgtttgctgtcttatg

SEQ ID NO: 50156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgctgtcttatgtggatg

SEQ ID NO: 50157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttatgtggatgtggttca

SEQ ID NO: 50158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaccccaaaacaattacca

SEQ ID NO: 50159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caattaccacagtaacaaca

SEQ ID NO: 50160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaacaaagatcactgatca

SEQ ID NO: 50161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atagatcaccataacacata

SEQ ID NO: 50162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacagtaataattaaataa

SEQ ID NO: 50163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaaataatggcaattaca

SEQ ID NO: 50164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacaaagttgaaatattgt

SEQ ID NO: 50165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatattgtgagaattgcca

SEQ ID NO: 50166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaattgccaaagtgtgaca

SEQ ID NO: 50167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgtgacacagatgcatg

SEQ ID NO: 50168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgacacagatgcatgaagt

SEQ ID NO: 50169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttgaaaaaattacgctga

SEQ ID NO: 50170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctgacagacttgcttaatg

SEQ ID NO: 50171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgacagacttgcttaatgc

SEQ ID NO: 50172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgacagacttgcttaatgca

SEQ ID NO: 50173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacaaaccttcaacttgta

SEQ ID NO: 50174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttcaacttgtaaagaatg

SEQ ID NO: 50175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaagaatgcagtatcttg

SEQ ID NO: 50176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtatcttgaagtgcaata

SEQ ID NO: 50177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttgaagtgcaataaagta

SEQ ID NO: 50178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtaaagccccataaaatg

SEQ ID NO: 50179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagtatgcctgtattttga

SEQ ID NO: 50180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtattttgatggaaacca

SEQ ID NO: 50181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttgatggaaaccaaagt

SEQ ID NO: 50182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttgatggaaaccaaagtt

SEQ ID NO: 50183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaaaccaaagttaggata

SEQ ID NO: 50184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaaccaaagttaggataa

SEQ ID NO: 50185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttaggataaaggttttta

SEQ ID NO: 50186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaaggtttttaaagaatg

SEQ ID NO: 50187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagaatgtagtgaaaaat

SEQ ID NO: 50188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagaatgtagtgaaaaata

SEQ ID NO: 50189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagaatgtagtgaaaaataa

SEQ ID NO: 50190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttcatatacacattcaa

SEQ ID NO: 50191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcatatacacattcaaaag

SEQ ID NO: 50192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatatacacattcaaaagt

SEQ ID NO: 50193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaagtaggatgattctga

SEQ ID NO: 50194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaagtaggatgattctgaa

SEQ ID NO: 50195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggatgattctgaaaggta

SEQ ID NO: 50196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggatgattctgaaaggtaaa

SEQ ID NO: 50197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattctgaaaggtaaagagt

SEQ ID NO: 50198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtaaagagtaagttatgact

SEQ ID NO: 50199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gactcggcaattccactact

SEQ ID NO: 50200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcaattccactacttggta

SEQ ID NO: 50201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccactacttggtacagactc

SEQ ID NO: 50202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactacttggtacagactca

SEQ ID NO: 50203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actacttggtacagactcaa

SEQ ID NO: 50204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaaacatatgtccacac

SEQ ID NO: 50205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaacgtttacatgaatgtt

SEQ ID NO: 50206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acgtttacatgaatgttcag

SEQ ID NO: 50207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcagcagcattattcatac

SEQ ID NO: 50208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattattcatactagccaaa

SEQ ID NO: 50209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attactcaccaatgaataaa

SEQ ID NO: 50210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caccaatgaataaatggata

SEQ ID NO: 50211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accaatgaataaatggataa

SEQ ID NO: 50212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaatggataaaggaatg

SEQ ID NO: 50213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataaatggataaaggaatgt

SEQ ID NO: 50214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggatattcaaacactgaat

SEQ ID NO: 50215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaacactgaattagtatt

SEQ ID NO: 50216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttagcaataaaaacaaatg

SEQ ID NO: 50217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caataaaaacaaatgaagta

SEQ ID NO: 50218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataaaaacaaatgaagtat

SEQ ID NO: 50219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataggtacatgttacaaca

SEQ ID NO: 50220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtgatgaaaaccccgtga

SEQ ID NO: 50221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaaccccgtgaaagaaca

SEQ ID NO: 50222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaccccgtgaaagaacaca

SEQ ID NO: 50223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgaaagaacacagagccaa

SEQ ID NO: 50224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaagaacacagagccaaa

SEQ ID NO: 50225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attccatcttatgaaatgtc

SEQ ID NO: 50226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttatgaaatgtccagaa

SEQ ID NO: 50227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttatgaaatgtccagaat

SEQ ID NO: 50228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtccagaataggcaaatccc

SEQ ID NO: 50229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatccccagaaacaaaatg

SEQ ID NO: 50230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atccccagaaacaaaatgta

SEQ ID NO: 50231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatgtagagtattttttgt

SEQ ID NO: 50232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtagagtattttttgtca

SEQ ID NO: 50233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagagtattttttgtcag

SEQ ID NO: 50234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagtattttttgtcagaggc

SEQ ID NO: 50235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtattttttgtcagaggct

SEQ ID NO: 50236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtcagaggctgggtgtaa

SEQ ID NO: 50237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtcagaggctgggtgtaat

SEQ ID NO: 50238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaggctgggtgtaatagg

SEQ ID NO: 50239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taataggaagtgattattga

SEQ ID NO: 50240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgattattgatggttatg

SEQ ID NO: 50241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgatggttatgtggttaa

SEQ ID NO: 50242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttatgtggttaatggtta

SEQ ID NO: 50243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatgtggttaatggttaaa

SEQ ID NO: 50244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggttaatggttaaagagta

SEQ ID NO: 50245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggttaatggttaaagagtat

SEQ ID NO: 50246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttaatggttaaagagtatg

SEQ ID NO: 50247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagagtatggggcttcttt

SEQ ID NO: 50248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagagtatggggcttctttt

SEQ ID NO: 50249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agagtatggggcttcttttg

SEQ ID NO: 50250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaacatactaaaaaccact

SEQ ID NO: 50251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgagtgatacactttaaaa

SEQ ID NO: 50252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaaaatggtgatttttta

SEQ ID NO: 50253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactactatgaatatgcatt

SEQ ID NO: 50254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatatgtgaaaattgtcct

SEQ ID NO: 50255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgaaaattgtcctcagaa

SEQ ID NO: 50256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgaaaattgtcctcagaat

SEQ ID NO: 50257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattgtcctcagaatagg

SEQ ID NO: 50258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattgtcctcagaataggaa

SEQ ID NO: 50259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctcagaataggaagagatt

SEQ ID NO: 50260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataggaagagatttagtaaa

SEQ ID NO: 50261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggaagagatttagtaaaa

SEQ ID NO: 50262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaatcaatgaatcaaatca

SEQ ID NO: 50263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaatgaatcaaatcaaag

SEQ ID NO: 50264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcagttgccacttgtgctt

SEQ ID NO: 50265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagttgccacttgtgctttg

SEQ ID NO: 50266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggagattcctcaacacttt

SEQ ID NO: 50267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacacttttggaaatcata

SEQ ID NO: 50268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacacttttggaaatcataa

SEQ ID NO: 50269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttttggaaatcataaaggt

SEQ ID NO: 50270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggaaatcataaaggtgag

SEQ ID NO: 50271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaatcataaaggtgagaaga

SEQ ID NO: 50272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcataaaggtgagaagac

SEQ ID NO: 50273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacgggataacttgcctcac

SEQ ID NO: 50274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacttgcctcactagacttt

SEQ ID NO: 50275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctcactagactttcagtg

SEQ ID NO: 50276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttcagtgtagacatactg

SEQ ID NO: 50277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagacatactgtggctcttg

SEQ ID NO: 50278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atactgtggctcttgaagaa

SEQ ID NO: 50279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtggctcttgaagaaaagt

SEQ ID NO: 50280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaagttggcttgaataac

SEQ ID NO: 50281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgaataactggtgtttttg

SEQ ID NO: 50282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtagattctacattcaac

SEQ ID NO: 50283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagattctacattcaactg

SEQ ID NO: 50284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagattctacattcaactgg

SEQ ID NO: 50285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agattctacattcaactgga

SEQ ID NO: 50286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggagggtaccatctctttc

SEQ ID NO: 50287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctttcaagaattatttga

SEQ ID NO: 50288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaattatttgacagaaatc

SEQ ID NO: 50289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaattatttgacagaaatct

SEQ ID NO: 50290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgacagaaatctaggtaca

SEQ ID NO: 50291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtacaaagatgttgtgaact

SEQ ID NO: 50292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaactcagatgtccattac

SEQ ID NO: 50293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccccatgcacatgctcaaca

SEQ ID NO: 50294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacatgctcaacacagctc

SEQ ID NO: 50295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacagctccagaatgacta

SEQ ID NO: 50296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgactaaagtatatgaaaa

SEQ ID NO: 50297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaaagtatatgaaaaaag

SEQ ID NO: 50298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaagtatatgaaaaaagca

SEQ ID NO: 50299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtatatgaaaaaagcag

SEQ ID NO: 50300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgaaaaaagcagaggca

SEQ ID NO: 50301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgaaaaaagcagaggcaa

SEQ ID NO: 50302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaaaaaagcagaggcaaa

SEQ ID NO: 50303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaagcagaggcaaaggg

SEQ ID NO: 50304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcaaagggtggtcaatgc

SEQ ID NO: 50305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaagggtggtcaatgctag

SEQ ID NO: 50306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgctagtggtaccatgca

SEQ ID NO: 50307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgctagtggtaccatgcat

SEQ ID NO: 50308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggcaatatttccctgatc

SEQ ID NO: 50309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccctgatcaagctaaatta

SEQ ID NO: 50310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccctgatcaagctaaattaa

SEQ ID NO: 50311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatcaagctaaattaaagg

SEQ ID NO: 50312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaattaaaggaagacact

SEQ ID NO: 50313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacatcatgatctgtgaaa

SEQ ID NO: 50314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcatgatctgtgaaatgg

SEQ ID NO: 50315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatctgtgaaatggaagttg

SEQ ID NO: 50316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgtgaaatggaagttgaa

SEQ ID NO: 50317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagttgaagagaccttgat

SEQ ID NO: 50318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagatttcatcatcatcctc

SEQ ID NO: 50319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcatcatcatcctctagtt

SEQ ID NO: 50320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catcatcatcctctagtttg

SEQ ID NO: 50321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatcatcctctagtttgga

SEQ ID NO: 50322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catcatcctctagtttggag

SEQ ID NO: 50323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttcattttactaatttta

SEQ ID NO: 50324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactaattttatagctttg

SEQ ID NO: 50325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaattttatagctttgaag

SEQ ID NO: 50326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattttatagctttgaagaa

SEQ ID NO: 50327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttatagctttgaagaagag

SEQ ID NO: 50328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctttgaagaagagcagctt

SEQ ID NO: 50329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaagaagagcagctttagt

SEQ ID NO: 50330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcagctttagttggcatct

SEQ ID NO: 50331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttggcatctgagtttgct

SEQ ID NO: 50332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcatctgagtttgcttgg

SEQ ID NO: 50333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgcttggaagttattgtac

SEQ ID NO: 50334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcttggaagttattgtacc

SEQ ID NO: 50335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaagttattgtaccaggc

SEQ ID NO: 50336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagttattgtaccaggccag

SEQ ID NO: 50337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agttattgtaccaggccagt

SEQ ID NO: 50338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttattgtaccaggccagtg

SEQ ID NO: 50339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgtaccaggccagtgggg

SEQ ID NO: 50340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taccaggccagtggggtggc

SEQ ID NO: 50341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagtggggtggcaagatga

SEQ ID NO: 50342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtggggtggcaagatgat

SEQ ID NO: 50343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcaagatgataggctga

SEQ ID NO: 50344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggcaagatgataggctgac

SEQ ID NO: 50345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggcaagatgataggctgaca

SEQ ID NO: 50346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgataggctgacagggtta

SEQ ID NO: 50347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataggctgacagggttaca

SEQ ID NO: 50348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataggctgacagggttacag

SEQ ID NO: 50349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggctgacagggttacaga

SEQ ID NO: 50350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agggttacagagggcaacat

SEQ ID NO: 50351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagggcaacataagtaaaaa

SEQ ID NO: 50352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggcaacataagtaaaaatg

SEQ ID NO: 50353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacttcaccaacacacaca

SEQ ID NO: 50354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcaccaacacacacaaag

SEQ ID NO: 50355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacaaagaagatgcaatga

SEQ ID NO: 50356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacaaagaagatgcaatgat

SEQ ID NO: 50357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaagaagatgcaatgatg

SEQ ID NO: 50358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaagatgcaatgatgggg

SEQ ID NO: 50359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaagatgcaatgatggggc

SEQ ID NO: 50360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caacttctttcctcttccct

SEQ ID NO: 50361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcctcttcccttagtcttc

SEQ ID NO: 50362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccttagtcttctggataaa

SEQ ID NO: 50363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttagtcttctggataaac

SEQ ID NO: 50364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttctggataaacaggcca

SEQ ID NO: 50365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttctggataaacaggccac

SEQ ID NO: 50366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctggataaacaggccacag

SEQ ID NO: 50367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggccacaggagttttcat

SEQ ID NO: 50368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccacaggagttttcattagt

SEQ ID NO: 50369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaggagttttcattagtc

SEQ ID NO: 50370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttcattagtcaggcatt

SEQ ID NO: 50371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attagtcaggcatttagttt

SEQ ID NO: 50372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggcatttagtttaagattt

SEQ ID NO: 50373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtttaagatttgagatttc

SEQ ID NO: 50374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaagatttgagatttctgg

SEQ ID NO: 50375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatttgagatttctggtg

SEQ ID NO: 50376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtggagtaaatatttaaa

SEQ ID NO: 50377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatttaaatggaaaaata

SEQ ID NO: 50378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagctcaaacattctaataa

SEQ ID NO: 50379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgaatacttatttaatgt

SEQ ID NO: 50380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaatacttatttaatgtga

SEQ ID NO: 50381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacttatttaatgtgagag

SEQ ID NO: 50382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acttatttaatgtgagagta

SEQ ID NO: 50383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatttaatgtgagagtaga

SEQ ID NO: 50384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatttaatgtgagagtagag

SEQ ID NO: 50385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagagtagagaggacttgta

SEQ ID NO: 50386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgtaaagcattacacca

SEQ ID NO: 50387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgtaaagcattacaccaa

SEQ ID NO: 50388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caccaaaggcaaaatcgaaa

SEQ ID NO: 50389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcaaaatcgaaaaagata

SEQ ID NO: 50390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcgaaaaagataaagaatgc

SEQ ID NO: 50391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatttaatctcataacaatg

SEQ ID NO: 50392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttaatctcataacaatga

SEQ ID NO: 50393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataacaatgaaggtttttaa

SEQ ID NO: 50394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaatgaaggtttttaaaag

SEQ ID NO: 50395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaaggtttttaaaagtgg

SEQ ID NO: 50396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaggtttttaaaagtgga

SEQ ID NO: 50397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcatccacaaaataaaaa

SEQ ID NO: 50398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaagtacaatacaaatga

SEQ ID NO: 50399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaatacaaatgacagatg

SEQ ID NO: 50400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttttcctttaatgaata

SEQ ID NO: 50401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaatatatctcataaaatt

SEQ ID NO: 50402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattatctaaaaatacaaa

SEQ ID NO: 50403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaaccatgtcaaacctcac

SEQ ID NO: 50404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaacctcactagtaatca

SEQ ID NO: 50405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaaatattaaaataaaca

SEQ ID NO: 50406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaatattaaaataaacat

SEQ ID NO: 50407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaatattaaaataaacatg

SEQ ID NO: 50408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaacatggggaaccaaatt

SEQ ID NO: 50409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatttggcctattaatcat

SEQ ID NO: 50410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcctattaatcattagca

SEQ ID NO: 50411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attagcaaagattttaacaa

SEQ ID NO: 50412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagattttaacaaaagtaa

SEQ ID NO: 50413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaaaagtaatagtgatat

SEQ ID NO: 50414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaaagtaatagtgatatta

SEQ ID NO: 50415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagtaatagtgatattaga

SEQ ID NO: 50416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtaatagtgatattagag

SEQ ID NO: 50417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtgatattagagaggtta

SEQ ID NO: 50418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgatattagagaggttat

SEQ ID NO: 50419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgatattagagaggttata

SEQ ID NO: 50420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgatattagagaggttatag

SEQ ID NO: 50421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagaggttataggggaaat

SEQ ID NO: 50422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaatcagtgttgcctgtc

SEQ ID NO: 50423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtgttgcctgtctggatga

SEQ ID NO: 50424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaataatgtgtactgtc

SEQ ID NO: 50425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataaataatgtgtactgtct

SEQ ID NO: 50426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taatgtgtactgtctgggtg

SEQ ID NO: 50427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgtactgtctgggtgcgg

SEQ ID NO: 50428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctataatcc

SEQ ID NO: 50429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctataatcccagaactt

SEQ ID NO: 50430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctataatcccagaacttt

SEQ ID NO: 50431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctataatcccagaactttgg

SEQ ID NO: 50432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataatcccagaactttggg

SEQ ID NO: 50433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcccagaactttgggaggcc

SEQ ID NO: 50434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagaactttgggaggccc

SEQ ID NO: 50435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaactttgggaggcccagg

SEQ ID NO: 50436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaactttgggaggcccaggc

SEQ ID NO: 50437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgggaggcccaggcagg

SEQ ID NO: 50438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcccaggcaggcagatcat

SEQ ID NO: 50439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcccaggcaggcagatcatg

SEQ ID NO: 50440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggcaggcagatcatgaggt

SEQ ID NO: 50441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcaggcagatcatgaggtc

SEQ ID NO: 50442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggcagatcatgaggtcag

SEQ ID NO: 50443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatcatgaggtcaggagatc

SEQ ID NO: 50444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagatcgagaccaacc

SEQ ID NO: 50445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaccctgtctctactaa

SEQ ID NO: 50446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactaaaagtacaaaaaaat

SEQ ID NO: 50447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagtacaaaaaaattagc

SEQ ID NO: 50448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtacaaaaaaattagcc

SEQ ID NO: 50449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaattagccaggcatgt

SEQ ID NO: 50450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattagccaggcatgttgg

SEQ ID NO: 50451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattagccaggcatgttggc

SEQ ID NO: 50452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcatgttggcaggcgccta

SEQ ID NO: 50453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggcaggcgcctatagtcc

SEQ ID NO: 50454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cgcctatagtcccagctgct

SEQ ID NO: 50455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctatagtcccagctgctc

SEQ ID NO: 50456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatagtcccagctgctcgg

SEQ ID NO: 50457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatagtcccagctgctcggg

SEQ ID NO: 50458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctgctcgggaggct

SEQ ID NO: 50459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctgctcgggaggctg

SEQ ID NO: 50460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctgctcgggaggctgagg

SEQ ID NO: 50461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgctcgggaggctgaggca

SEQ ID NO: 50462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgggaggctgaggcagagaa

SEQ ID NO: 50463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcagagaatggcgtgaacc

SEQ ID NO: 50464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagagaatggcgtgaaccc

SEQ ID NO: 50465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaatggcgtgaacccag

SEQ ID NO: 50466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaatggcgtgaacccagg

SEQ ID NO: 50467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatggcgtgaacccaggagg

SEQ ID NO: 50468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggcgtgaacccaggaggcg

SEQ ID NO: 50469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccaggaggcggagcttg

SEQ ID NO: 50470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggaggcggagcttgcagt

SEQ ID NO: 50471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcggagcttgcagtgagcc

SEQ ID NO: 50472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatcgtgccactgcactc

SEQ ID NO: 50473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtgccactgcactccagcc

SEQ ID NO: 50474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgccactgcactccagcct

SEQ ID NO: 50475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgcactccagcctgggcaa

SEQ ID NO: 50476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgggcaata

SEQ ID NO: 50477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagcctgggcaatagagc

SEQ ID NO: 50478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccgtctcaaataaataaata

SEQ ID NO: 50479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataaagtgtacaaacttttt

SEQ ID NO: 50480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaagtgtacaaactttttg

SEQ ID NO: 50481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagtgtacaaactttttga

SEQ ID NO: 50482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttgtaatatctatcaa

SEQ ID NO: 50483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgccaaataattttccttc

SEQ ID NO: 50484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgccaaataattttccttct

SEQ ID NO: 50485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccttctaggaatttattca

SEQ ID NO: 50486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaggaatttattcaaaga

SEQ ID NO: 50487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttattcaaagacagtaatct

SEQ ID NO: 50488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattcaaagacagtaatctc

SEQ ID NO: 50489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatcaatccaaaatcctaa

SEQ ID NO: 50490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatccaaaatcctaacagt

SEQ ID NO: 50491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatccaaaatcctaacagta

SEQ ID NO: 50492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atccaaaatcctaacagtaa

SEQ ID NO: 50493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaagggttacactaaatg

SEQ ID NO: 50494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaatgtataatgaaataat

SEQ ID NO: 50495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtataatgaaataatgag

SEQ ID NO: 50496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaataatgagcagctttga

SEQ ID NO: 50497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataatgagcagctttgaaa

SEQ ID NO: 50498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatgagcagctttgaaaga

SEQ ID NO: 50499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctttgaaagagagcgttca

SEQ ID NO: 50500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaaatataatgcataat

SEQ ID NO: 50501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatataatgcataataag

SEQ ID NO: 50502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgcataataagtggaatc

SEQ ID NO: 50503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcataataagtggaatcc

SEQ ID NO: 50504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaatccaggttatacaca

SEQ ID NO: 50505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atccaggttatacacacaga

SEQ ID NO: 50506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatacacaatgcatttaaca

SEQ ID NO: 50507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaatgcatttaacaaagtt

SEQ ID NO: 50508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catttaacaaagtttagccc

SEQ ID NO: 50509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaaagtttagccctagtt

SEQ ID NO: 50510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaagtttagccctagttaa

SEQ ID NO: 50511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagccctagttaagagatta

SEQ ID NO: 50512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatgtcatgtttttctatc

SEQ ID NO: 50513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtcatgtttttctatccag

SEQ ID NO: 50514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtttttctatccagaaga

SEQ ID NO: 50515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatttgacctaattttata

SEQ ID NO: 50516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactatgattgtatcttctt

SEQ ID NO: 50517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatcccaatgttgcatata

SEQ ID NO: 50518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcccaatgttgcatataa

SEQ ID NO: 50519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccaatgttgcatataaagg

SEQ ID NO: 50520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actcaccattaatctcatat

SEQ ID NO: 50521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaccattaatctcatatta

SEQ ID NO: 50522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctcatattagagaatact

SEQ ID NO: 50523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcatattagagaatactt

SEQ ID NO: 50524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtgttattcttgtatct

SEQ ID NO: 50525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgtatctaagatttccta

SEQ ID NO: 50526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcctatagttaaaatcaata

SEQ ID NO: 50527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttcttattttctatgtatg

SEQ ID NO: 50528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcagacacacacatatata

SEQ ID NO: 50529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatctatgcttatccatcta

SEQ ID NO: 50530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatcatgtatttgtctatc

SEQ ID NO: 50531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttcttcacacatctttc

SEQ ID NO: 50532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcacacatctttccagtca

SEQ ID NO: 50533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttccagtcaaagcaatgt

SEQ ID NO: 50534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcaaagcaatgtcagctcc

SEQ ID NO: 50535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagctcccagttcatgaaaa

SEQ ID NO: 50536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgtgtttatcacactctc

SEQ ID NO: 50537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggccttcaaatttccattg

SEQ ID NO: 50538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttccattgcagtaaaaaca

SEQ ID NO: 50539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagtaaaaacaaagatgta

SEQ ID NO: 50540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaaaacaaagatgtacag

SEQ ID NO: 50541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatgtacagtggcgaaatgt

SEQ ID NO: 50542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagataatatcactaaaaac

SEQ ID NO: 50543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataatatcactaaaaacca

SEQ ID NO: 50544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataatatcactaaaaaccag

SEQ ID NO: 50545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcactaaaaaccagagg

SEQ ID NO: 50546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaccagaggaagacaaaaa

SEQ ID NO: 50547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaagttatcataaatcat

SEQ ID NO: 50548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cataaatcataagattaccc

SEQ ID NO: 50549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcataagattaccctagt

SEQ ID NO: 50550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcataagattaccctagtg

SEQ ID NO: 50551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataagattaccctagtgag

SEQ ID NO: 50552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaccctagtgaggagatca

SEQ ID NO: 50553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccctagtgaggagatcaaag

SEQ ID NO: 50554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagtgaggagatcaaagcag

SEQ ID NO: 50555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagatcaaagcagaagcta

SEQ ID NO: 50556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaagcagaagctacagtc

SEQ ID NO: 50557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagtctagaacactcatct

SEQ ID NO: 50558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaacactcatctgagaatgt

SEQ ID NO: 50559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaatgttagaatttctttc

SEQ ID NO: 50560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgttagaatttctttctag

SEQ ID NO: 50561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttagaatttctttctagca

SEQ ID NO: 50562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatttctttctagcagag

SEQ ID NO: 50563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttctagcagagaagtca

SEQ ID NO: 50564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagaagtcacagatttcta

SEQ ID NO: 50565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctatggcaaatatgtgatg

SEQ ID NO: 50566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcaaatatgtgatgtagat

SEQ ID NO: 50567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgatgtagatcagaaaac

SEQ ID NO: 50568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaacaagttgattaatcca

SEQ ID NO: 50569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatttattcaataatgttg

SEQ ID NO: 50570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccctctctatgttaaatatg

SEQ ID NO: 50571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctctatgttaaatatgtag

SEQ ID NO: 50572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctatgttaaatatgtagca

SEQ ID NO: 50573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgttaaatatgtagcagag

SEQ ID NO: 50574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcagagtggtttatctcc

SEQ ID NO: 50575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctccaagctatcaccaa

SEQ ID NO: 50576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctccaagctatcaccaaa

SEQ ID NO: 50577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggataatatctgcattaatt

SEQ ID NO: 50578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataatatctgcattaatta

SEQ ID NO: 50579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatctgcattaattaagg

SEQ ID NO: 50580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatctgcattaattaaggt

SEQ ID NO: 50581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaattaaggtaggactcc

SEQ ID NO: 50582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaattaaggtaggactcct

SEQ ID NO: 50583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taattaaggtaggactccta

SEQ ID NO: 50584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagggtatccatgtccattt

SEQ ID NO: 50585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatccatgtccattttagc

SEQ ID NO: 50586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtccattttagctagaac

SEQ ID NO: 50587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtccattttagctagaacc

SEQ ID NO: 50588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtccattttagctagaacca

SEQ ID NO: 50589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattttagctagaaccaggg

SEQ ID NO: 50590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttagctagaaccagggtg

SEQ ID NO: 50591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctagaaccagggtggagtc

SEQ ID NO: 50592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagaaccagggtggagtcg

SEQ ID NO: 50593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagaaccagggtggagtcga

SEQ ID NO: 50594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accagggtggagtcgaggga

SEQ ID NO: 50595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccagggtggagtcgagggaa

SEQ ID NO: 50596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catccatacatcctaaaatg

SEQ ID NO: 50597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaaaatgtagcctgcctgt

SEQ ID NO: 50598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaccatacatgtatataca

SEQ ID NO: 50599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtatatacacagaccttt

SEQ ID NO: 50600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcagtcatccctctctttc

SEQ ID NO: 50601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtcatccctctctttcaa

SEQ ID NO: 50602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcatccctctctttcaaga

SEQ ID NO: 50603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatccctctctttcaagag

SEQ ID NO: 50604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttcaagagaggatttgtc

SEQ ID NO: 50605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttcaagagaggatttgtct

SEQ ID NO: 50606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagaggatttgtctgggaaa

SEQ ID NO: 50607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgggaaacagacctgtata

SEQ ID NO: 50608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaacagacctgtataaaga

SEQ ID NO: 50609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataaagacagatgcaaacc

SEQ ID NO: 50610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacctggccaacaccaacc

SEQ ID NO: 50611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttcttccataaatattaa

SEQ ID NO: 50612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatattaatagattatc

SEQ ID NO: 50613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagattatcaagaataaat

SEQ ID NO: 50614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaagaataaattggtaatg

SEQ ID NO: 50615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaccaaacataaaattga

SEQ ID NO: 50616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacataaaattgaaagact

SEQ ID NO: 50617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattgaaagactaagatgaa

SEQ ID NO: 50618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagaccaaacttttaactt

SEQ ID NO: 50619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttaactttagaaaaaaaa

SEQ ID NO: 50620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaaaaaagcaaacattg

SEQ ID NO: 50621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaaaaagcaaacattgt

SEQ ID NO: 50622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaaacattgtgggatatt

SEQ ID NO: 50623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacattgtgggatattgag

SEQ ID NO: 50624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgggatattgagaagtta

SEQ ID NO: 50625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggatattgagaagttaaagt

SEQ ID NO: 50626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagttaaagttagtattcc

SEQ ID NO: 50627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttaaagttagtattccta

SEQ ID NO: 50628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtattcctagagaaattt

SEQ ID NO: 50629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtattcctagagaaatttg

SEQ ID NO: 50630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattcctagagaaatttgag

SEQ ID NO: 50631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctagagaaatttgaggaga

SEQ ID NO: 50632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagagaaatttgaggagaca

SEQ ID NO: 50633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttattaaaaaaaaaaaa

SEQ ID NO: 50634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttattaaaaaaaaaaaat

SEQ ID NO: 50635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaacaacaacatcaattc

SEQ ID NO: 50636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaacaacaacatcaattct

SEQ ID NO: 50637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaacatcaattctgggta

SEQ ID NO: 50638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaacatcaattctgggtaa

SEQ ID NO: 50639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgtgaaacaaaaaattt

SEQ ID NO: 50640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgaaacaaaaaatttcag

SEQ ID NO: 50641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagtagaatgcttgctgaa

SEQ ID NO: 50642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtagaatgcttgctgaaa

SEQ ID NO: 50643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagaatgcttgctgaaaag

SEQ ID NO: 50644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgcttgctgaaaaggag

SEQ ID NO: 50645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaggagaagtcataattg

SEQ ID NO: 50646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaccttttactttacccaa

SEQ ID NO: 50647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taccttttactttacccaaa

SEQ ID NO: 50648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accttttactttacccaaaa

SEQ ID NO: 50649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttttactttacccaaaag

SEQ ID NO: 50650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccaaaaggggcactttac

SEQ ID NO: 50651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaggggcactttaccagaa

SEQ ID NO: 50652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggggcactttaccagaat

SEQ ID NO: 50653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggggcactttaccagaatg

SEQ ID NO: 50654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actttaccagaatggggcac

SEQ ID NO: 50655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccagaatggggcaccagt

SEQ ID NO: 50656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggcaccagtgagcattct

SEQ ID NO: 50657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggcaccagtgagcattctc

SEQ ID NO: 50658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtgagcattctcaggtgc

SEQ ID NO: 50659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctataccttgatctatgtga

SEQ ID NO: 50660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatctatgtgatggttaca

SEQ ID NO: 50661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatctatgtgatggttacat

SEQ ID NO: 50662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgtatatgtaaaaatgca

SEQ ID NO: 50663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtatatgtaaaaatgcatg

SEQ ID NO: 50664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgcatggagttctatatct

SEQ ID NO: 50665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagatttttctatatattt

SEQ ID NO: 50666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagatttttctatatatttt

SEQ ID NO: 50667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatttttctatatattttag

SEQ ID NO: 50668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaattttaaaaattaaaa

SEQ ID NO: 50669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaagtacaaaataaaact

SEQ ID NO: 50670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtacaaaataaaacttag

SEQ ID NO: 50671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaataaaacttagaagata

SEQ ID NO: 50672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatccatgttgttcgacat

SEQ ID NO: 50673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttgttcgacattagtctc

SEQ ID NO: 50674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgttcgacattagtctcaa

SEQ ID NO: 50675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcgacattagtctcaaga

SEQ ID NO: 50676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgacattagtctcaagagag

SEQ ID NO: 50677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtctcaagagagcagcaaa

SEQ ID NO: 50678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcaagagagcagcaaatag

SEQ ID NO: 50679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagagcagcaaatagtaga

SEQ ID NO: 50680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagagcagcaaatagtagat

SEQ ID NO: 50681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagataggaaataataaaca

SEQ ID NO: 50682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaataataaacaaagtaa

SEQ ID NO: 50683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataataaacaaagtaatgg

SEQ ID NO: 50684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatggcagaaaattcacc

SEQ ID NO: 50685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatggcagaaaattcaccaa

SEQ ID NO: 50686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattcaccaagagtcatc

SEQ ID NO: 50687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaagagtcatcaagctaa

SEQ ID NO: 50688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatcaagctaaaagtacaa

SEQ ID NO: 50689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaagctaaaagtacaaaag

SEQ ID NO: 50690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaaagaagatcaatttaa

SEQ ID NO: 50691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagttccattcttgtga

SEQ ID NO: 50692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttccattcttgtgaaagtt

SEQ ID NO: 50693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccattcttgtgaaagttta

SEQ ID NO: 50694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtttagagcattaacaa

SEQ ID NO: 50695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagcattaacaatagaaac

SEQ ID NO: 50696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttataatcttccaaaaat

SEQ ID NO: 50697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataagataactaactaaa

SEQ ID NO: 50698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taactaaaaagaatgaaaat

SEQ ID NO: 50699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gattgccattaaaatttcct

SEQ ID NO: 50700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttagccataattgacac

SEQ ID NO: 50701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagaacacaatcaatgcttt

SEQ ID NO: 50702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaatgctttcagtgtgat

SEQ ID NO: 50703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatgctttcagtgtgatga

SEQ ID NO: 50704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgaatcaaattctattat

SEQ ID NO: 50705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcagacaacctattatc

SEQ ID NO: 50706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacctattatcaagtgtga

SEQ ID NO: 50707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggcaaacaaaatatatttc

SEQ ID NO: 50708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcaaacaaaatatatttct

SEQ ID NO: 50709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatatatttctaggtat

SEQ ID NO: 50710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctttttatctttttttttt

SEQ ID NO: 50711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttttttttttaagttactt

SEQ ID NO: 50712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttaagttactttggatt

SEQ ID NO: 50713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttaagttactttggatta

SEQ ID NO: 50714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagttactttggattaagg

SEQ ID NO: 50715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttactttggattaaggta

SEQ ID NO: 50716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggtagagcaaaaaaaaaa

SEQ ID NO: 50717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaagtacttctaaaacaca

SEQ ID NO: 50718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctaaaacacatagaatac

SEQ ID NO: 50719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatacaagatgtttcacaaa

SEQ ID NO: 50720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcacaaatagtgtgaataa

SEQ ID NO: 50721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatagtgtgaataaaagca

SEQ ID NO: 50722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatagtgtgaataaaagcaa

SEQ ID NO: 50723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atagtgtgaataaaagcaaa

SEQ ID NO: 50724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaagggaatttgtttctt

SEQ ID NO: 50725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttctttagaacgtgtaaa

SEQ ID NO: 50726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatagccatattgtccaaa

SEQ ID NO: 50727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatagccatattgtccaaat

SEQ ID NO: 50728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataggaatcaattcaaaat

SEQ ID NO: 50729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataggaatcaattcaaaatg

SEQ ID NO: 50730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaggcatgaacttgaacaac

SEQ ID NO: 50731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatgaacttgaacaactgg

SEQ ID NO: 50732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaacaactggtagaattg

SEQ ID NO: 50733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaactggtagaattgaag

SEQ ID NO: 50734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caactggtagaattgaagca

SEQ ID NO: 50735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actggtagaattgaagcaga

SEQ ID NO: 50736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctggtagaattgaagcagag

SEQ ID NO: 50737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagcagagaggatccactt

SEQ ID NO: 50738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgagtttgatgtgttcttc

SEQ ID NO: 50739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtttgatgtgttcttcaag

SEQ ID NO: 50740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgatgtgttcttcaagtag

SEQ ID NO: 50741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgtgttcttcaagtagca

SEQ ID NO: 50742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagtagcagagtttgaat

SEQ ID NO: 50743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagtagcagagtttgaatga

SEQ ID NO: 50744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtagcagagtttgaatgag

SEQ ID NO: 50745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaggtttaaattcctcctc

SEQ ID NO: 50746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataatattgttaaattgtat

SEQ ID NO: 50747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaaatgtgccaattacca

SEQ ID NO: 50748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaagcatatataaaatgt

SEQ ID NO: 50749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaaatgtaagtacaatta

SEQ ID NO: 50750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatagaactttatttacaca

SEQ ID NO: 50751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactttatttacacaaagac

SEQ ID NO: 50752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatatgtgttaaatattat

SEQ ID NO: 50753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttaaatattatcagtgtaa

SEQ ID NO: 50754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattatcagtgtaaaagtaa

SEQ ID NO: 50755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcagtgtaaaagtaatggaa

SEQ ID NO: 50756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggaatagcttacaaaaatt

SEQ ID NO: 50757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatagcttacaaaaattga

SEQ ID NO: 50758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatagcttacaaaaattgag

SEQ ID NO: 50759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcttacaaaaattgagagg

SEQ ID NO: 50760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttacaaaaattgagaggta

SEQ ID NO: 50761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttacaaaaattgagaggtag

SEQ ID NO: 50762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacaaaaattgagaggtaga

SEQ ID NO: 50763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaaaattgagaggtagag

SEQ ID NO: 50764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaaattgagaggtagagg

SEQ ID NO: 50765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgagaggtagagggggat

SEQ ID NO: 50766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagaggtagagggggattag

SEQ ID NO: 50767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtagagggggattagtggt

SEQ ID NO: 50768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtagagggggattagtggtg

SEQ ID NO: 50769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagagggggattagtggtga

SEQ ID NO: 50770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggggattagtggtgagggaa

SEQ ID NO: 50771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attagtggtgagggaaaagt

SEQ ID NO: 50772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtggtgagggaaaagttg

SEQ ID NO: 50773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtggtgagggaaaagttgga

SEQ ID NO: 50774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaccccttatcttacattg

SEQ ID NO: 50775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaccccttatcttacattga

SEQ ID NO: 50776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccttatcttacattgaagg

SEQ ID NO: 50777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatcttacattgaaggcagt

SEQ ID NO: 50778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaggcagttagtgcatcc

SEQ ID NO: 50779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagttagtgcatcctggcta

SEQ ID NO: 50780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgcatcctggctaaagttt

SEQ ID NO: 50781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggctaaagtttaagtaac

SEQ ID NO: 50782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtttaagtaacaagaaa

SEQ ID NO: 50783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtttaagtaacaagaaata

SEQ ID NO: 50784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttaagtaacaagaaatag

SEQ ID NO: 50785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtaacaagaaatagaggtt

SEQ ID NO: 50786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaacaagaaatagaggttc

SEQ ID NO: 50787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttcaggtatattccattta

SEQ ID NO: 50788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcaggtatattccatttaa

SEQ ID NO: 50789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaggtataaatccaaccca

SEQ ID NO: 50790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atccaacccatagaattact

SEQ ID NO: 50791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaatgaaaacataactgct

SEQ ID NO: 50792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacataactgcttggaattt

SEQ ID NO: 50793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactgcttggaatttgagaa

SEQ ID NO: 50794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actgcttggaatttgagaat

SEQ ID NO: 50795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgcttggaatttgagaatg

SEQ ID NO: 50796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttggaatttgagaatgggg

SEQ ID NO: 50797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatttgagaatggggcaga

SEQ ID NO: 50798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttgagaatggggcagaaa

SEQ ID NO: 50799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatggggcagaaagagaa

SEQ ID NO: 50800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaattcctcattttcaaat

SEQ ID NO: 50801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcctcattttcaaattaga

SEQ ID NO: 50802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcattttcaaattagaaagt

SEQ ID NO: 50803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagttagaaaacattacat

SEQ ID NO: 50804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagttgatgaaataaaaat

SEQ ID NO: 50805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaaataaaaatgagacat

SEQ ID NO: 50806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagacataagcatattatt

SEQ ID NO: 50807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacataagcatattattta

SEQ ID NO: 50808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatattatttagagataaa

SEQ ID NO: 50809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catattatttagagataaaa

SEQ ID NO: 50810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagataaaaaggaaaatat

SEQ ID NO: 50811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaaacttttttttaaaa

SEQ ID NO: 50812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaacttttttttaaaaaag

SEQ ID NO: 50813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacttttttttaaaaaagc

SEQ ID NO: 50814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttttttaaaaaagcggg

SEQ ID NO: 50815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcgggaagtgattattccc

SEQ ID NO: 50816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgattattccctagataa

SEQ ID NO: 50817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttccctagataatggcttta

SEQ ID NO: 50818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccctagataatggctttaa

SEQ ID NO: 50819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccctagataatggctttaaa

SEQ ID NO: 50820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatggctttaaagggata

SEQ ID NO: 50821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagcaaaaattgtttgaat

SEQ ID NO: 50822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcatttgttaattttataa

SEQ ID NO: 50823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagttattattatgattaaa

SEQ ID NO: 50824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaaaaagctgtaaaataa

SEQ ID NO: 50825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaagctgtaaaataaaag

SEQ ID NO: 50826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatattatacctctctctt

SEQ ID NO: 50827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatacctctctcttgagcca

SEQ ID NO: 50828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagccaaagaaaccaacaaa

SEQ ID NO: 50829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaccaacaaacagctgctt

SEQ ID NO: 50830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaacaaacagctgcttaag

SEQ ID NO: 50831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactgttctgttaccttcac

SEQ ID NO: 50832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actgttctgttaccttcact

SEQ ID NO: 50833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcactgggcttgaaaaata

SEQ ID NO: 50834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctttcaaacaccatatatt

SEQ ID NO: 50835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacattattttgatctcttt

SEQ ID NO: 50836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acattattttgatctctttc

SEQ ID NO: 50837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgatctctttcaggtaaat

SEQ ID NO: 50838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatctctttcaggtaaattg

SEQ ID NO: 50839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttattaatatttcttcttc

SEQ ID NO: 50840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattaatatttcttcttca

SEQ ID NO: 50841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattaatatttcttcttcaa

SEQ ID NO: 50842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacacactgcaaacactca

SEQ ID NO: 50843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgcaaacactcaaagtta

SEQ ID NO: 50844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacactcaaagttacagta

SEQ ID NO: 50845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtcttctactttctctgct

SEQ ID NO: 50846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgaatactgaacacttcat

SEQ ID NO: 50847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaatactgaacacttcatt

SEQ ID NO: 50848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttcattgggtgctaccaa

SEQ ID NO: 50849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattgggtgctaccaatggc

SEQ ID NO: 50850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggctggcttgctgaatgca

SEQ ID NO: 50851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctgacaccaattcttcca

SEQ ID NO: 50852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacaccaattcttccatagt

SEQ ID NO: 50853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attcttccatagtgagcttt

SEQ ID NO: 50854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatagtgagctttgagatg

SEQ ID NO: 50855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catagtgagctttgagatgt

SEQ ID NO: 50856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatccctttcacttatgt

SEQ ID NO: 50857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatccctttcacttatgtt

SEQ ID NO: 50858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaggtaatgttaaaaatg

SEQ ID NO: 50859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatgttaaaaatgcagct

SEQ ID NO: 50860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaagtatcatttgtctcta

SEQ ID NO: 50861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttgtctctatggttgtc

SEQ ID NO: 50862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgtctctatggttgtcaa

SEQ ID NO: 50863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttgtcaagagtgtatatat

SEQ ID NO: 50864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagtgtatatatcagaatg

SEQ ID NO: 50865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagtgtatatatcagaatgc

SEQ ID NO: 50866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgcaggtatactccactg

SEQ ID NO: 50867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actccactgtggctattgac

SEQ ID NO: 50868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctccactgtggctattgacc

SEQ ID NO: 50869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tccactgtggctattgacca

SEQ ID NO: 50870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtgtaacctaaaaaaata

SEQ ID NO: 50871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctaaaaaaatacagatgc

SEQ ID NO: 50872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctaaaaaaatacagatgcc

SEQ ID NO: 50873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaaaaaaatacagatgcca

SEQ ID NO: 50874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagatgccagggcttatct

SEQ ID NO: 50875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaagtaatgctgaaataa

SEQ ID NO: 50876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatgctgaaataaaagttt

SEQ ID NO: 50877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgctgaaataaaagtttt

SEQ ID NO: 50878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgctgaaataaaagtttta

SEQ ID NO: 50879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaaataaaagttttaggg

SEQ ID NO: 50880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaataaaagttttagggaa

SEQ ID NO: 50881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagttttagggaagagcat

SEQ ID NO: 50882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagcatgtctacttttaaa

SEQ ID NO: 50883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgttaaatcaaaaatat

SEQ ID NO: 50884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaatcaaaaatatcagat

SEQ ID NO: 50885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtacacatacatcaatgac

SEQ ID NO: 50886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtacacatacatcaatgacc

SEQ ID NO: 50887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaccaggttttattattcaa

SEQ ID NO: 50888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accaggttttattattcaaa

SEQ ID NO: 50889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggttttattattcaaaag

SEQ ID NO: 50890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggttttattattcaaaagga

SEQ ID NO: 50891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaaaaaattcaattcaaa

SEQ ID NO: 50892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaattcaattcaaaaag

SEQ ID NO: 50893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcaattcaaaaagtagaa

SEQ ID NO: 50894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaaaaagtagaaaagtttt

SEQ ID NO: 50895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaagtttttggattttgtt

SEQ ID NO: 50896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggattttgtttggtttg

SEQ ID NO: 50897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtaaaatacacaacttta

SEQ ID NO: 50898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagttaactattttaaaat

SEQ ID NO: 50899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaactattttaaaattgga

SEQ ID NO: 50900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taactattttaaaattggaa

SEQ ID NO: 50901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaacataaattccattcaa

SEQ ID NO: 50902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaattccattcaatagac

SEQ ID NO: 50903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaattccattcaatagacc

SEQ ID NO: 50904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccattcaatagaccaggca

SEQ ID NO: 50905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attcaatagaccaggcacag

SEQ ID NO: 50906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcctgtaattccaacatttt

SEQ ID NO: 50907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaattccaacattttcg

SEQ ID NO: 50908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaattccaacattttcgg

SEQ ID NO: 50909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttccaacattttcggaggcc

SEQ ID NO: 50910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccaacattttcggaggcca

SEQ ID NO: 50911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aacattttcggaggccaagg

SEQ ID NO: 50912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acattttcggaggccaaggc

SEQ ID NO: 50913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaaggcgggtgaatcactt

SEQ ID NO: 50914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaggcgggtgaatcacttg

SEQ ID NO: 50915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggcgggtgaatcacttga

SEQ ID NO: 50916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcgggtgaatcacttgaggg

SEQ ID NO: 50917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgggtgaatcacttgagggc

SEQ ID NO: 50918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtgaatcacttgagggcag

SEQ ID NO: 50919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacttgagggcaggagttc

SEQ ID NO: 50920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagggcaggagttcaagaa

SEQ ID NO: 50921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaggagttcaagaacagca

SEQ ID NO: 50922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagttcaagaacagcat

SEQ ID NO: 50923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagaacagcatgggcaaca

SEQ ID NO: 50924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acacagtgacaccctgtctc

SEQ ID NO: 50925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacagtgacaccctgtctct

SEQ ID NO: 50926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacaccctgtctctaggaa

SEQ ID NO: 50927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaggaaaagtacaaaaat

SEQ ID NO: 50928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaaagtacaaaaattagc

SEQ ID NO: 50929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaagtacaaaaattagcc

SEQ ID NO: 50930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtacaaaaattagccaggca

SEQ ID NO: 50931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaaaattagccaggcatg

SEQ ID NO: 50932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcatggagctgtgcacctg

SEQ ID NO: 50933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagctgtgcacctgtagtct

SEQ ID NO: 50934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctgtagtctcagctgctt

SEQ ID NO: 50935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtagtctcagctgcttga

SEQ ID NO: 50936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtctcagctgcttgagag

SEQ ID NO: 50937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagctgcttgagagtagct

SEQ ID NO: 50938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagctgcttgagagtagcta

SEQ ID NO: 50939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgcttgagagtagctaagg

SEQ ID NO: 50940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcttgagagtagctaaggt

SEQ ID NO: 50941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttgagagtagctaaggtgg

SEQ ID NO: 50942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgagagtagctaaggtggg

SEQ ID NO: 50943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaaggtgggaggatcacct

SEQ ID NO: 50944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgggaggatcacctgagcc

SEQ ID NO: 50945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggaggatcacctgagcct

SEQ ID NO: 50946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggaggatcacctgagcctg

SEQ ID NO: 50947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaggatcacctgagcctggg

SEQ ID NO: 50948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggatcacctgagcctgggg

SEQ ID NO: 50949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacctgagcctggggaggtt

SEQ ID NO: 50950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctggggaggttgagtctg

SEQ ID NO: 50951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggggaggttgagtctgcagt

SEQ ID NO: 50952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gagccatgatcacaccactg

SEQ ID NO: 50953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgatcacaccactgcggtc

SEQ ID NO: 50954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaccactgcggtccagct

SEQ ID NO: 50955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcggtccagcttggatga

SEQ ID NO: 50956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtccagcttggatgacaga

SEQ ID NO: 50957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagcttggatgacagaca

SEQ ID NO: 50958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaaatctatcaattcaa

SEQ ID NO: 50959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caacacatattttgaactcc

SEQ ID NO: 50960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctctattatgttcaatta

SEQ ID NO: 50961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattatgttcaattaaaga

SEQ ID NO: 50962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgttcaattaaagaaag

SEQ ID NO: 50963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgttcaattaaagaaagaa

SEQ ID NO: 50964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaattaaagaaagaagagt

SEQ ID NO: 50965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagaaagaagagttggaat

SEQ ID NO: 50966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaagaagagttggaatg

SEQ ID NO: 50967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaaagaagagttggaatga

SEQ ID NO: 50968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaagaagagttggaatgag

SEQ ID NO: 50969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaactgaatgaaaaaaa

SEQ ID NO: 50970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactgaatgaaaaaaatgg

SEQ ID NO: 50971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgaaaaaaatggaagttg

SEQ ID NO: 50972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaaaaaaatggaagttga

SEQ ID NO: 50973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaaaaatggaagttgaag

SEQ ID NO: 50974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaatggaagttgaagga

SEQ ID NO: 50975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatggaagttgaaggagag

SEQ ID NO: 50976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatggaagttgaaggagaga

SEQ ID NO: 50977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagttgaaggagagaagg

SEQ ID NO: 50978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggaagatgataaaccaaa

SEQ ID NO: 50979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggaagatgataaaccaaaa

SEQ ID NO: 50980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaagatgataaaccaaaaa

SEQ ID NO: 50981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaccaaaaagggtaaaaaa

SEQ ID NO: 50982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttaattctcaacatttt

SEQ ID NO: 50983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatcacttcattccaatta

SEQ ID NO: 50984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttcattccaattatagcc

SEQ ID NO: 50985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttttttttttttttttt

SEQ ID NO: 50986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtaactcttattctctcc

SEQ ID NO: 50987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattctctccaagttctttt

SEQ ID NO: 50988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctctccaagttcttttg

SEQ ID NO: 50989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaagttcttttgaggcatg

SEQ ID NO: 50990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggcatgcagtgctcctcct

SEQ ID NO: 50991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatgcagtgctcctcctca

SEQ ID NO: 50992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccctcatcctccaaacctgt

SEQ ID NO: 50993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccaaacctgtcagctcta

SEQ ID NO: 50994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtcagctctaaagcatcct

SEQ ID NO: 50995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctcagtcaatctgttgtc

SEQ ID NO: 50996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaatctgttgtcaagcaat

SEQ ID NO: 50997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgttgtcaagcaataagc

SEQ ID NO: 50998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgtcaagcaataagcaag

SEQ ID NO: 50999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcaagcaataagcaagaag

SEQ ID NO: 51000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaagcaataagcaagaaga

SEQ ID NO: 51001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaataagcaagaagaagg

SEQ ID NO: 51002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgatgctgtaaaataatc

SEQ ID NO: 51003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgatgctgtaaaataatcaa

SEQ ID NO: 51004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaataatcaagagttacat

SEQ ID NO: 51005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaataatcaagagttacatt

SEQ ID NO: 51006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagttacattaggtctttcc

SEQ ID NO: 51007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacgctgatcttccaacttt

SEQ ID NO: 51008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acgctgatcttccaactttc

SEQ ID NO: 51009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtgtaacaacattcaaa

SEQ ID NO: 51010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaacaacattcaaaaaga

SEQ ID NO: 51011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaacaacattcaaaaagaa

SEQ ID NO: 51012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattcaaaaagaaaggaca

SEQ ID NO: 51013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaggacaaagatactaa

SEQ ID NO: 51014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaaagatactaaaagaaa

SEQ ID NO: 51015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaatagatttattttat

SEQ ID NO: 51016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttactttatgaaacactact

SEQ ID NO: 51017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaatttcattttattt

SEQ ID NO: 51018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcattttatttgagtttcta

SEQ ID NO: 51019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctatagtttcttcttaatt

SEQ ID NO: 51020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatagtttcttcttaatttg

SEQ ID NO: 51021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgtaaaatctttaatata

SEQ ID NO: 51022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaaaatgaataaaatcctt

SEQ ID NO: 51023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaataaaatccttcagcaa

SEQ ID NO: 51024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagttacaatatatatcatg

SEQ ID NO: 51025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtgtacttctattccata

SEQ ID NO: 51026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatacagaacaattcacac

SEQ ID NO: 51027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaacaattcacactggttt

SEQ ID NO: 51028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaattcacactggtttcag

SEQ ID NO: 51029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acactggtttcagtggctca

SEQ ID NO: 51030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactggtttcagtggctcac

SEQ ID NO: 51031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacaggtcaataatcatct

SEQ ID NO: 51032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaatttgtgctccacattt

SEQ ID NO: 51033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttgtgctccacatttta

SEQ ID NO: 51034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttagagctgttgaccctg

SEQ ID NO: 51035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttagagctgttgaccctgtg

SEQ ID NO: 51036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagatgacataacctctct

SEQ ID NO: 51037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacataacctctctgagcct

SEQ ID NO: 51038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctctgagcctaagattcc

SEQ ID NO: 51039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattcctagtttgaaaaatt

SEQ ID NO: 51040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagttaataatcatgctccg

SEQ ID NO: 51041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttaataatcatgctccgaa

SEQ ID NO: 51042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataatcatgctccgaagag

SEQ ID NO: 51043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatgctccgaagagtggtt

SEQ ID NO: 51044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagagtggtttagattgtga

SEQ ID NO: 51045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgatggttaactgtatata

SEQ ID NO: 51046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgtatataaagtgcttaa

SEQ ID NO: 51047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgtatataaagtgcttaac

SEQ ID NO: 51048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatataaagtgcttaacagg

SEQ ID NO: 51049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tataaagtgcttaacaggaa

SEQ ID NO: 51050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acataatgaacacgtattca

SEQ ID NO: 51051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataatgaacacgtattcatg

SEQ ID NO: 51052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacgtattcatggagctcat

SEQ ID NO: 51053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctattttaattccttgctt

SEQ ID NO: 51054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatattaattatattaaat

SEQ ID NO: 51055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatattaattatattaaatg

SEQ ID NO: 51056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgaggatatttccattta

SEQ ID NO: 51057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaggatatttccatttat

SEQ ID NO: 51058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccatttatgggaatgtat

SEQ ID NO: 51059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaacatgaaacatttcatat

SEQ ID NO: 51060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgagcatgtaatattaaa

SEQ ID NO: 51061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagcatgtaatattaaaca

SEQ ID NO: 51062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaatattaaacagagatt

SEQ ID NO: 51063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattaaacagagatttagtt

SEQ ID NO: 51064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaacagagatttagttta

SEQ ID NO: 51065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacagagatttagtttagag

SEQ ID NO: 51066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagatttagtttagagtagt

SEQ ID NO: 51067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagtttagagtagtgagtc

SEQ ID NO: 51068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagtttagagtagtgagtct

SEQ ID NO: 51069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagagtagtgagtctaggac

SEQ ID NO: 51070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtgagtctaggacaagtt

SEQ ID NO: 51071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgagtctaggacaagttc

SEQ ID NO: 51072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagtctaggacaagttcag

SEQ ID NO: 51073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaggacaagttcaggagc

SEQ ID NO: 51074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggacaagttcaggagctaga

SEQ ID NO: 51075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttcaggagctagaaagcc

SEQ ID NO: 51076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttcaggagctagaaagcct

SEQ ID NO: 51077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagcctgggttttgaatac

SEQ ID NO: 51078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atactggattcactacttac

SEQ ID NO: 51079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttactagctaaatgatct

SEQ ID NO: 51080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaaatgatcttggacatcc

SEQ ID NO: 51081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatcttggacatcccagtt

SEQ ID NO: 51082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttctgattctaaaaatgtt

SEQ ID NO: 51083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctgattctaaaaatgttg

SEQ ID NO: 51084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaaaaatgttgaggcatt

SEQ ID NO: 51085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaaaatgttgaggcattt

SEQ ID NO: 51086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtaattttaaacaatac

SEQ ID NO: 51087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaattttaaacaatacaa

SEQ ID NO: 51088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacaatacaagagtatccc

SEQ ID NO: 51089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgactgttgattgctca

SEQ ID NO: 51090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgactgttgattgctcaa

SEQ ID NO: 51091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgttgattgctcaaaggat

SEQ ID NO: 51092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgttgattgctcaaaggatt

SEQ ID NO: 51093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaaaggattgggtcactg

SEQ ID NO: 51094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgcagaatttcctttctt

SEQ ID NO: 51095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgttttgaactttatatg

SEQ ID NO: 51096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgcaaaatattttttaat

SEQ ID NO: 51097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatattttttaattagaca

SEQ ID NO: 51098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaattagacaaagtcatg

SEQ ID NO: 51099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagacaaagtcatgtggctc

SEQ ID NO: 51100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggctcaagaactatcatt

SEQ ID NO: 51101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcattgaatattgctgaa

SEQ ID NO: 51102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcattgaatattgctgaac

SEQ ID NO: 51103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcattgaatattgctgaaca

SEQ ID NO: 51104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattgctgaacagggtcaa

SEQ ID NO: 51105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaaataaattccaacact

SEQ ID NO: 51106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caacacttggtttatcttct

SEQ ID NO: 51107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcattaatgtaatctctgaa

SEQ ID NO: 51108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatctctgaacagaatac

SEQ ID NO: 51109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagaatgatcccttccttc

SEQ ID NO: 51110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgatcccttccttcaagca

SEQ ID NO: 51111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttcaagcaaagaaatatta

SEQ ID NO: 51112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaatattacagtctctc

SEQ ID NO: 51113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaatattacagtctctcca

SEQ ID NO: 51114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacagtctctccagagttt

SEQ ID NO: 51115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagtctctccagagtttta

SEQ ID NO: 51116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttagagactctgtgtgcc

SEQ ID NO: 51117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagactctgtgtgcctggta

SEQ ID NO: 51118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atggctctgaacatactatt

SEQ ID NO: 51119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgaacatactatttggaaaa

SEQ ID NO: 51120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggaaaacggtattcttg

SEQ ID NO: 51121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtattcttgaagtcaaatat

SEQ ID NO: 51122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcttgaagtcaaatattgg

SEQ ID NO: 51123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaagtcaaatattggaag

SEQ ID NO: 51124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatattggaagcagacat

SEQ ID NO: 51125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatattggaagcagacatc

SEQ ID NO: 51126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagacatcaggaaaattatt

SEQ ID NO: 51127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agacatcaggaaaattattt

SEQ ID NO: 51128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacatcaggaaaattatttg

SEQ ID NO: 51129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acatcaggaaaattatttgg

SEQ ID NO: 51130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggggacttcctttcatcccc

SEQ ID NO: 51131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggacttcctttcatcccca

SEQ ID NO: 51132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactatgaaaacccttcaca

SEQ ID NO: 51133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actatgaaaacccttcacat

SEQ ID NO: 51134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctatgaaaacccttcacata

SEQ ID NO: 51135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttcacatagggaaaatcta

SEQ ID NO: 51136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcacatagggaaaatctat

SEQ ID NO: 51137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagggaaaatctataggat

SEQ ID NO: 51138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagggaaaatctataggatg

SEQ ID NO: 51139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaaatctataggatgagg

SEQ ID NO: 51140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaatctataggatgaggt

SEQ ID NO: 51141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatctataggatgaggtggg

SEQ ID NO: 51142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctataggatgaggtgggaag

SEQ ID NO: 51143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tataggatgaggtgggaagt

SEQ ID NO: 51144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtgggaagtgggtttccct

SEQ ID NO: 51145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggtttccctaagtgttca

SEQ ID NO: 51146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcctctaaaaaatcactg

SEQ ID NO: 51147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttttacctaataactaa

SEQ ID NO: 51148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttttacctaataactaaa

SEQ ID NO: 51149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taactaaaaggaaaaaatgt

SEQ ID NO: 51150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgagttgtgcccattatat

SEQ ID NO: 51151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtgcccattatattagac

SEQ ID NO: 51152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccattatattagactggaa

SEQ ID NO: 51153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccattatattagactggaaa

SEQ ID NO: 51154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattagactggaaaaggtct

SEQ ID NO: 51155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagactggaaaaggtctcag

SEQ ID NO: 51156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtggcctctattaccttct

SEQ ID NO: 51157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaccttcttggccacataa

SEQ ID NO: 51158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taccttcttggccacataac

SEQ ID NO: 51159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtactaaatactccaaactg

SEQ ID NO: 51160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagttcccaaatgatttat

SEQ ID NO: 51161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccaaatgatttattagtgt

SEQ ID NO: 51162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaaatgatttattagtgtc

SEQ ID NO: 51163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaatgatttattagtgtca

SEQ ID NO: 51164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagggcaccaattctattg

SEQ ID NO: 51165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaccaattctattgtggct

SEQ ID NO: 51166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caattctattgtggctcagt

SEQ ID NO: 51167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attctattgtggctcagtta

SEQ ID NO: 51168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtttatcttatatatga

SEQ ID NO: 51169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgaaagctatatttattt

SEQ ID NO: 51170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaaagctatatttatttaa

SEQ ID NO: 51171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatatttatttaagagaat

SEQ ID NO: 51172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attctcttaaaaatatctcc

SEQ ID NO: 51173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcccagataattcctttaaa

SEQ ID NO: 51174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataacttttgacatctcttg

SEQ ID NO: 51175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttgacatctcttgtaga

SEQ ID NO: 51176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacatctcttgtagaaagc

SEQ ID NO: 51177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catctcttgtagaaagcaag

SEQ ID NO: 51178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtttctttaatcttgat

SEQ ID NO: 51179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtttctttaatcttgatta

SEQ ID NO: 51180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttctttaatcttgattag

SEQ ID NO: 51181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttctttaatcttgattaga

SEQ ID NO: 51182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgacattttcttatttc

SEQ ID NO: 51183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgacattttcttatttca

SEQ ID NO: 51184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgacattttcttatttcaag

SEQ ID NO: 51185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cattttcttatttcaaggag

SEQ ID NO: 51186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttcttatttcaaggagc

SEQ ID NO: 51187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttcaaggagcaggaaaa

SEQ ID NO: 51188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actctatattttcttatttc

SEQ ID NO: 51189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctatattttcttatttca

SEQ ID NO: 51190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatattttcttatttcaag

SEQ ID NO: 51191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattttcttatttcaaggag

SEQ ID NO: 51192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttcttatttcaaggagc

SEQ ID NO: 51193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttcaaggagcaggaaaa

SEQ ID NO: 51194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcacaactctataataattt

SEQ ID NO: 51195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaactctataataatttc

SEQ ID NO: 51196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttttgcattccatcact

SEQ ID NO: 51197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcgataaaattacaacaat

SEQ ID NO: 51198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaaattacaacaattagc

SEQ ID NO: 51199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaattacaacaattagcc

SEQ ID NO: 51200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacaacaattagccaggtg

SEQ ID NO: 51201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaattagccaggtgtggtg

SEQ ID NO: 51202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caattagccaggtgtggtgt

SEQ ID NO: 51203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgtgggcgcctgcaatct

SEQ ID NO: 51204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgcctgcaatctcagctact

SEQ ID NO: 51205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcctgcaatctcagctactc

SEQ ID NO: 51206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgcaatctcagctactcag

SEQ ID NO: 51207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcaatctcagctactcagg

SEQ ID NO: 51208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcagctactcaggaggct

SEQ ID NO: 51209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcagctactcaggaggctg

SEQ ID NO: 51210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctactcaggaggctgagg

SEQ ID NO: 51211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctactcaggaggctgaggc

SEQ ID NO: 51212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactcaggaggctgaggcag

SEQ ID NO: 51213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggagaattacttgaacc

SEQ ID NO: 51214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagaattacttgaacccag

SEQ ID NO: 51215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaattacttgaacccagc

SEQ ID NO: 51216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattacttgaacccagcagg

SEQ ID NO: 51217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacttgaacccagcaggca

SEQ ID NO: 51218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacttgaacccagcaggcag

SEQ ID NO: 51219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccagcaggcagaggttg

SEQ ID NO: 51220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagcaggcagaggttgcagt

SEQ ID NO: 51221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcagaggttgcagtgagcc

SEQ ID NO: 51222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatcgcgccactgcactc

SEQ ID NO: 51223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactgcactccagcctgaac

SEQ ID NO: 51224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgcactccagcctgaacca

SEQ ID NO: 51225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgaaccaga

SEQ ID NO: 51226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctccagcctgaaccagagag

SEQ ID NO: 51227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tccagcctgaaccagagagc

SEQ ID NO: 51228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatttatttatttaaaat

SEQ ID NO: 51229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattggtccaattaatcatt

SEQ ID NO: 51230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtccaattaatcatttgg

SEQ ID NO: 51231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatctgccaaaatctgaat

SEQ ID NO: 51232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccaaaatctgaatgagatt

SEQ ID NO: 51233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatctgaatgagattgagt

SEQ ID NO: 51234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgagtcagtataaatattt

SEQ ID NO: 51235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcagtataaatatttaaga

SEQ ID NO: 51236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtataaatatttaagacag

SEQ ID NO: 51237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagacagtggacaaatgta

SEQ ID NO: 51238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttgaaaatgtcacttctc

SEQ ID NO: 51239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcacttctctagaaacaca

SEQ ID NO: 51240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacatagtgattttttcctg

SEQ ID NO: 51241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatagtgattttttcctgc

SEQ ID NO: 51242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaggtaaaatcttgactg

SEQ ID NO: 51243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagtaccattaattttta

SEQ ID NO: 51244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatttttaaagcattctc

SEQ ID NO: 51245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatttttaaagcattctca

SEQ ID NO: 51246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagcattctcaaggcacca

SEQ ID NO: 51247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctcaaggcaccatagaat

SEQ ID NO: 51248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaccatagaatcagaacat

SEQ ID NO: 51249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagaacatgagaacctaaa

SEQ ID NO: 51250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaagtttatttaaatca

SEQ ID NO: 51251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccattgatactatgtgat

SEQ ID NO: 51252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgatactatgtgatgagaa

SEQ ID NO: 51253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttccttcccaaaactta

SEQ ID NO: 51254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatagccttaatctaaccat

SEQ ID NO: 51255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaaccatgagaaaaatat

SEQ ID NO: 51256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatcagacaaataccaatt

SEQ ID NO: 51257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcagacaaataccaattc

SEQ ID NO: 51258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctaacctatactcactca

SEQ ID NO: 51259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatcaacatcatcaaaaac

SEQ ID NO: 51260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcaacatcatcaaaaaca

SEQ ID NO: 51261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatcatcaaaaacaagga

SEQ ID NO: 51262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaaaaacaaggaaagcct

SEQ ID NO: 51263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaagcctgagaaattgcga

SEQ ID NO: 51264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgagaaattgcgacagcc

SEQ ID NO: 51265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagaaattgcgacagccta

SEQ ID NO: 51266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcgacagcctagagatgctt

SEQ ID NO: 51267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgacagcctagagatgctta

SEQ ID NO: 51268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatgcttaaggtgatatga

SEQ ID NO: 51269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggtgatatgatggtatga

SEQ ID NO: 51270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgatggttaaatgtaatg

SEQ ID NO: 51271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatggttaaatgtaatgtgg

SEQ ID NO: 51272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaatgtaatgtggtagcc

SEQ ID NO: 51273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaatgtaatgtggtagcct

SEQ ID NO: 51274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaatgtggtagcctgggt

SEQ ID NO: 51275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcctgggtgagatcttga

SEQ ID NO: 51276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcctgggtgagatcttgaaa

SEQ ID NO: 51277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgagatcttgaaagagaaa

SEQ ID NO: 51278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagatcttgaaagagaaaa

SEQ ID NO: 51279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgaaagagaaaaaggaaat

SEQ ID NO: 51280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggaaattagtgaaaaact

SEQ ID NO: 51281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggaaattagtgaaaaacta

SEQ ID NO: 51282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaactaaggaactctgaa

SEQ ID NO: 51283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaactaaggaactctgaat

SEQ ID NO: 51284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaactaaggaactctgaata

SEQ ID NO: 51285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggaactctgaatagggt

SEQ ID NO: 51286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaactctgaatagggta

SEQ ID NO: 51287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggaactctgaatagggtaa

SEQ ID NO: 51288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataataatgatgtatcaca

SEQ ID NO: 51289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaatataaactgttaataa

SEQ ID NO: 51290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatataaactgttaataac

SEQ ID NO: 51291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatataaactgttaataaca

SEQ ID NO: 51292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atataaactgttaataacag

SEQ ID NO: 51293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgttaataacaggggaaac

SEQ ID NO: 51294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataacaggggaaactggatg

SEQ ID NO: 51295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taacaggggaaactggatgt

SEQ ID NO: 51296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacaggggaaactggatgtg

SEQ ID NO: 51297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttccataaatctattcc

SEQ ID NO: 51298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatctattccaagacaa

SEQ ID NO: 51299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattccaagacaaaagttt

SEQ ID NO: 51300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagacaaaagtttaagcaa

SEQ ID NO: 51301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagacaaaagtttaagcaaa

SEQ ID NO: 51302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttaagcaaaaggaaatca

SEQ ID NO: 51303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaaaggaaatcacagatg

SEQ ID NO: 51304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattattctaatattaaata

SEQ ID NO: 51305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attattctaatattaaataa

SEQ ID NO: 51306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattaaataaaggtaataa

SEQ ID NO: 51307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaataaaggtaataatagct

SEQ ID NO: 51308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcagtgaatttgaatttat

SEQ ID NO: 51309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcagtgaatttgaatttatc

SEQ ID NO: 51310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattatctataatatacct

SEQ ID NO: 51311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataatatacctaagtgataa

SEQ ID NO: 51312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaaaatacatattttaca

SEQ ID NO: 51313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattttacacagtacaaaa

SEQ ID NO: 51314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagcattgctttgatcaa

SEQ ID NO: 51315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atagcattgctttgatcaat

SEQ ID NO: 51316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcattgctttgatcaatag

SEQ ID NO: 51317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatcaataggagatccat

SEQ ID NO: 51318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatccattagaaatgctgat

SEQ ID NO: 51319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgctgatcagttttctta

SEQ ID NO: 51320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcttaaagtaatcatgcc

SEQ ID NO: 51321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcttaaagtaatcatgcct

SEQ ID NO: 51322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttaaagtaatcatgcctgg

SEQ ID NO: 51323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaagtaatcatgcctggg

SEQ ID NO: 51324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttctataaatgcactctcc

SEQ ID NO: 51325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctataaatgcactctcct

SEQ ID NO: 51326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaatgcactctcctgggt

SEQ ID NO: 51327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaatgcactctcctgggtc

SEQ ID NO: 51328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactctcctgggtcaggaat

SEQ ID NO: 51329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagcttatgacttataaaca

SEQ ID NO: 51330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttataaacatagaactaaac

SEQ ID NO: 51331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataaacatagaactaaactg

SEQ ID NO: 51332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaactggagtcacaatgtct

SEQ ID NO: 51333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgagtcctaattatactt

SEQ ID NO: 51334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagtcctaattatacttga

SEQ ID NO: 51335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcattatgtcttattataa

SEQ ID NO: 51336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcattatgtcttattataat

SEQ ID NO: 51337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggctaaaaaaatacacttat

SEQ ID NO: 51338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctaaaaaaatacacttatg

SEQ ID NO: 51339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaaaaaaatacacttatga

SEQ ID NO: 51340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatctgtgtgtattttcttt

SEQ ID NO: 51341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgtattttcttttagaat

SEQ ID NO: 51342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatttaactccctcaacca

SEQ ID NO: 51343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaactccctcaaccatggt

SEQ ID NO: 51344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcatactaaatatctttt

SEQ ID NO: 51345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttttaagttgttaaattg

SEQ ID NO: 51346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccatcttaatgatgccgtt

SEQ ID NO: 51347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccatcttaatgatgccgtta

SEQ ID NO: 51348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgatgccgttaaggtacaa

SEQ ID NO: 51349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatgccgttaaggtacaaa

SEQ ID NO: 51350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgatttctgtgttactt

SEQ ID NO: 51351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgatttctgtgttacttt

SEQ ID NO: 51352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgttactttaggaactgt

SEQ ID NO: 51353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgttactttaggaactgtg

SEQ ID NO: 51354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaggaactgtgaggtaaca

SEQ ID NO: 51355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaactgtgaggtaacata

SEQ ID NO: 51356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgaggtaacatagagataa

SEQ ID NO: 51357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagaaatgtatttgactct

SEQ ID NO: 51358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgagattctcattttact

SEQ ID NO: 51359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaacacctgataacatcat

SEQ ID NO: 51360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacacctgataacatcatca

SEQ ID NO: 51361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctgataacatcatcagagc

SEQ ID NO: 51362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcagagcaagacaaaaata

SEQ ID NO: 51363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaaatacagctccactc

SEQ ID NO: 51364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagctccactctggctgac

SEQ ID NO: 51365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagctccactctggctgaca

SEQ ID NO: 51366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacaaggatacgcttaaccc

SEQ ID NO: 51367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accctggtttataactacaa

SEQ ID NO: 51368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacttatctactcataacat

SEQ ID NO: 51369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cataagacttcccatgataa

SEQ ID NO: 51370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagacttcccatgataaaa

SEQ ID NO: 51371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaaagagaaatatgtcat

SEQ ID NO: 51372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaagagaaatatgtcatc

SEQ ID NO: 51373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagagaaatatgtcatcag

SEQ ID NO: 51374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaaatatgtcatcagga

SEQ ID NO: 51375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatatgtcatcaggagagat

SEQ ID NO: 51376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgtcatcaggagagatga

SEQ ID NO: 51377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtcatcaggagagatgaga

SEQ ID NO: 51378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcatcaggagagatgagag

SEQ ID NO: 51379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagaggcaatgtttccttc

SEQ ID NO: 51380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccttccagtatgaactctta

SEQ ID NO: 51381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttccagtatgaactcttat

SEQ ID NO: 51382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggccttctcccatgaaaa

SEQ ID NO: 51383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgaaaacagaaaaatttc

SEQ ID NO: 51384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaacagaaaaatttccaga

SEQ ID NO: 51385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaactctgttctatgtct

SEQ ID NO: 51386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgttctatgtcttggcacc

SEQ ID NO: 51387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttggcaccaagaaaatat

SEQ ID NO: 51388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggcaccaagaaaatattg

SEQ ID NO: 51389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggagtccttcctacacc

SEQ ID NO: 51390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacctggcctccgattgaat

SEQ ID NO: 51391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattgaataagtgaaatatc

SEQ ID NO: 51392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattctatatgtcaataac

SEQ ID NO: 51393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatgtcaataacaagata

SEQ ID NO: 51394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agataaagctgaaacattca

SEQ ID NO: 51395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaaacattcaaagacaat

SEQ ID NO: 51396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacattcaaagacaataag

SEQ ID NO: 51397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacaataagaagtacaatt

SEQ ID NO: 51398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtacaatttagtcattgaa

SEQ ID NO: 51399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttagtcattgaatagctcta

SEQ ID NO: 51400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattgaatagctctacagtt

SEQ ID NO: 51401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatagctctacagtttagat

SEQ ID NO: 51402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctctacagtttagataaga

SEQ ID NO: 51403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtttagataagaaagtca

SEQ ID NO: 51404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtttagataagaaagtcaa

SEQ ID NO: 51405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggtgcgaaacgattgaatc

SEQ ID NO: 51406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgcgaaacgattgaatctg

SEQ ID NO: 51407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acgattgaatctggagaata

SEQ ID NO: 51408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgattgaatctggagaatac

SEQ ID NO: 51409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gattgaatctggagaataca

SEQ ID NO: 51410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgaatctggagaatacag

SEQ ID NO: 51411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaaaataatacttaaacc

SEQ ID NO: 51412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatgtgctccttgaattat

SEQ ID NO: 51413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgtgctccttgaattata

SEQ ID NO: 51414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgtgctccttgaattataa

SEQ ID NO: 51415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgaattataagggtatct

SEQ ID NO: 51416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatacctgataacatctt

SEQ ID NO: 51417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatacctgataacatctttg

SEQ ID NO: 51418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atacctgataacatctttgg

SEQ ID NO: 51419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctgataacatctttggagg

SEQ ID NO: 51420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgataacatctttggagga

SEQ ID NO: 51421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatctttggaggaaggaaa

SEQ ID NO: 51422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttggaggaaggaaataga

SEQ ID NO: 51423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaaatagacagctctaccc

SEQ ID NO: 51424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacagctctaccctagctgt

SEQ ID NO: 51425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagctctaccctagctgtc

SEQ ID NO: 51426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagctctaccctagctgtca

SEQ ID NO: 51427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataaatttgattcaatcct

SEQ ID NO: 51428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatttgattcaatccttgg

SEQ ID NO: 51429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttgattcaatccttggc

SEQ ID NO: 51430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatccttggcaggatgtcta

SEQ ID NO: 51431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctacagcatttatgttcc

SEQ ID NO: 51432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcatttatgttccaagc

SEQ ID NO: 51433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagcatttatgttccaagcc

SEQ ID NO: 51434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaagccaggattttgtgtc

SEQ ID NO: 51435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaataaatgctacacaaca

SEQ ID NO: 51436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacacaacacagaaaatacc

SEQ ID NO: 51437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caacacagaaaataccaaga

SEQ ID NO: 51438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacagaaaataccaagacag

SEQ ID NO: 51439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagaaaataccaagacagc

SEQ ID NO: 51440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagacagcaggaatgacct

SEQ ID NO: 51441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaatgaccttggactgttc

SEQ ID NO: 51442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaatgaccttggactgttct

SEQ ID NO: 51443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaccttggactgttctaggc

SEQ ID NO: 51444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggactgttctaggcaagct

SEQ ID NO: 51445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatgatgatcttaccatt

SEQ ID NO: 51446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgatgatcttaccattga

SEQ ID NO: 51447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttaccattgagagatcct

SEQ ID NO: 51448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaccattgagagatccttg

SEQ ID NO: 51449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgagagatccttggagaaa

SEQ ID NO: 51450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttggagaaatagccaaa

SEQ ID NO: 51451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttggagaaatagccaaat

SEQ ID NO: 51452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaatagccaaataggaccc

SEQ ID NO: 51453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatagccaaataggaccca

SEQ ID NO: 51454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaaataggacccaaggtcc

SEQ ID NO: 51455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatacttttctttttttat

SEQ ID NO: 51456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atacttttctttttttatga

SEQ ID NO: 51457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttttttatgagagcatat

SEQ ID NO: 51458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctactgactattctttatca

SEQ ID NO: 51459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactattctttatcaaagt

SEQ ID NO: 51460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctttatcaaagtaagcca

SEQ ID NO: 51461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttattgtgaacttttctga

SEQ ID NO: 51462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacttttctgaaagattttg

SEQ ID NO: 51463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagattttgtggctgcacaa

SEQ ID NO: 51464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggctgcacaacagtgctg

SEQ ID NO: 51465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgcacaacagtgctgtagt

SEQ ID NO: 51466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacaacagtgctgtagtaag

SEQ ID NO: 51467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatgtcatatattaatcac

SEQ ID NO: 51468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatattaatcactagtgtt

SEQ ID NO: 51469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actttgcttaaataacatcc

SEQ ID NO: 51470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttgcttaaataacatcct

SEQ ID NO: 51471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgcttaaataacatccta

SEQ ID NO: 51472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcttaaataacatcctagg

SEQ ID NO: 51473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataacatcctagggagtct

SEQ ID NO: 51474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacatcctagggagtcttg

SEQ ID NO: 51475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctagggagtcttggagctt

SEQ ID NO: 51476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttggagcttgagaacatt

SEQ ID NO: 51477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaacattcagataacta

SEQ ID NO: 51478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaacattcagataactaa

SEQ ID NO: 51479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taactaaaggttcttgactt

SEQ ID NO: 51480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactaaaggttcttgacttc

SEQ ID NO: 51481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggttcttgacttcaggctg

SEQ ID NO: 51482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttgacttcaggctgaagac

SEQ ID NO: 51483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgacttcaggctgaagact

SEQ ID NO: 51484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctgaagactgggaccacta

SEQ ID NO: 51485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgaagactgggaccactat

SEQ ID NO: 51486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttatcttcaaatattgtt

SEQ ID NO: 51487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcaattaaaattcaatga

SEQ ID NO: 51488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcaattaaaattcaatgaa

SEQ ID NO: 51489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacttttcattttctgtctt

SEQ ID NO: 51490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaatattgcgtttatacca

SEQ ID NO: 51491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattgcgtttataccacag

SEQ ID NO: 51492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattgcgtttataccacaga

SEQ ID NO: 51493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcgtttataccacagaag

SEQ ID NO: 51494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcgtttataccacagaagg

SEQ ID NO: 51495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttataccacagaaggagg

SEQ ID NO: 51496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaggaggcagctgtaata

SEQ ID NO: 51497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaggaggcagctgtaatat

SEQ ID NO: 51498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaggcagctgtaatatggg

SEQ ID NO: 51499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagctgtaatatgggcaga

SEQ ID NO: 51500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaatatgggcagaaagtat

SEQ ID NO: 51501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatgagtttaaatttttga

SEQ ID NO: 51502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgagtttaaatttttgaa

SEQ ID NO: 51503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaattttcttataaacac

SEQ ID NO: 51504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaattttcttataaacaca

SEQ ID NO: 51505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctcactcactctgttgcc

SEQ ID NO: 51506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcactcactctgttgccc

SEQ ID NO: 51507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactctgttgcccaggttg

SEQ ID NO: 51508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcagtgcaatactgtgatca

SEQ ID NO: 51509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atactgtgatcacggctcac

SEQ ID NO: 51510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actgtgatcacggctcactg

SEQ ID NO: 51511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatcatcctcgtgcactc

SEQ ID NO: 51512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcgacctcccaccttccc

SEQ ID NO: 51513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgacctcccaccttcccaag

SEQ ID NO: 51514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcccaccttcccaagtagc

SEQ ID NO: 51515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcccaccttcccaagtagct

SEQ ID NO: 51516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcccaagtagctgggacca

SEQ ID NO: 51517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaagtagctgggaccac

SEQ ID NO: 51518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaggtgcgtgccaccatgc

SEQ ID NO: 51519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggtgcgtgccaccatgct

SEQ ID NO: 51520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgctgggctaatttttta

SEQ ID NO: 51521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttttaaagcattttttg

SEQ ID NO: 51522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttaaagcattttttgta

SEQ ID NO: 51523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagcattttttgtagagac

SEQ ID NO: 51524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcattttttgtagagaca

SEQ ID NO: 51525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaggtctcaccatgttgcc

SEQ ID NO: 51526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggtctcaccatgttgccc

SEQ ID NO: 51527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaggctcgtcttgaactcc

SEQ ID NO: 51528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggctcgtcttgaactcct

SEQ ID NO: 51529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtcttgaactcctgggctc

SEQ ID NO: 51530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcaagtgatctgccctcct

SEQ ID NO: 51531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgccctccttggcctccca

SEQ ID NO: 51532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccttggcctcccaaagtgc

SEQ ID NO: 51533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttggcctcccaaagtgct

SEQ ID NO: 51534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttggcctcccaaagtgctg

SEQ ID NO: 51535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgctggggtta

SEQ ID NO: 51536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgctggggttac

SEQ ID NO: 51537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggttacaggcatcaaccact

SEQ ID NO: 51538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggcatcaaccactgagcc

SEQ ID NO: 51539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttatcttactcttcccc

SEQ ID NO: 51540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttactcttcccctagtc

SEQ ID NO: 51541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttcccctagtctagatt

SEQ ID NO: 51542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctagattcagtaaaaacaa

SEQ ID NO: 51543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggttgtaatttattatatt

SEQ ID NO: 51544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggttgtaatttattatattt

SEQ ID NO: 51545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttgtaatttattatattta

SEQ ID NO: 51546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaccaaatctatacactt

SEQ ID NO: 51547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accaaatctatacacttaag

SEQ ID NO: 51548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaatctatacacttaagta

SEQ ID NO: 51549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttaagtagagtaaaaacac

SEQ ID NO: 51550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagtaaaaacactggaatt

SEQ ID NO: 51551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaaacactggaattgagc

SEQ ID NO: 51552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatctttttataatcttat

SEQ ID NO: 51553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataatcttattagaaataaa

SEQ ID NO: 51554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcttcactatgaatttgtc

SEQ ID NO: 51555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttcactatgaatttgtcc

SEQ ID NO: 51556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtccaggccatttcactaa

SEQ ID NO: 51557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggccatttcactaaaagac

SEQ ID NO: 51558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcactaaaagactagcat

SEQ ID NO: 51559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaaaagactagcatgagc

SEQ ID NO: 51560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaaagactagcatgagcc

SEQ ID NO: 51561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagccaggataactctccc

SEQ ID NO: 51562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gataactctccccagacctc

SEQ ID NO: 51563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctctagccctgataactct

SEQ ID NO: 51564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcacatctcattgatact

SEQ ID NO: 51565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcacatctcattgatacta

SEQ ID NO: 51566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacatctcattgatactaag

SEQ ID NO: 51567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaaggagctttctctaac

SEQ ID NO: 51568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaggagctttctctaaca

SEQ ID NO: 51569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctttctctaacaaggtgc

SEQ ID NO: 51570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctttctctaacaaggtgct

SEQ ID NO: 51571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactattgtccatgaataca

SEQ ID NO: 51572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacagcttcatttaactaat

SEQ ID NO: 51573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcttcatttaactaattag

SEQ ID NO: 51574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagtagaattttatgtacc

SEQ ID NO: 51575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagtagaattttatgtacct

SEQ ID NO: 51576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgtacctgggaactttt

SEQ ID NO: 51577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtacctgggaacttttaa

SEQ ID NO: 51578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaagagtatgaaatcctac

SEQ ID NO: 51579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagtatgaaatcctacaag

SEQ ID NO: 51580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctacaagcagtgtatctt

SEQ ID NO: 51581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttagcctgtaacattgct

SEQ ID NO: 51582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtaacattgcttggaaca

SEQ ID NO: 51583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taacattgcttggaacaaag

SEQ ID NO: 51584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaaagcagacctgtcatt

SEQ ID NO: 51585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacctgtcatttggttttg

SEQ ID NO: 51586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttggttttgtagcctttg

SEQ ID NO: 51587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttgtagtccctgacactc

SEQ ID NO: 51588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccctgacactctggaacat

SEQ ID NO: 51589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgacactctggaacatta

SEQ ID NO: 51590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgacactctggaacattaga

SEQ ID NO: 51591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acactctggaacattagaga

SEQ ID NO: 51592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagagtgaaaatattattc

SEQ ID NO: 51593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagtgaaaatattattcta

SEQ ID NO: 51594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaatattattctagagtg

SEQ ID NO: 51595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatattattctagagtga

SEQ ID NO: 51596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaattctgtgttttcatcc

SEQ ID NO: 51597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtgttttcatcccagtat

SEQ ID NO: 51598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatcccagtattggttaca

SEQ ID NO: 51599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catggtttgtttcgtttgtg

SEQ ID NO: 51600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcatcaaactatatttt

SEQ ID NO: 51601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcatcaaactatattttt

SEQ ID NO: 51602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttttaacttttatttt

SEQ ID NO: 51603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaacttttattttaagtt

SEQ ID NO: 51604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaacttttattttaagttc

SEQ ID NO: 51605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacttttattttaagttcag

SEQ ID NO: 51606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattttaagttcaggagtac

SEQ ID NO: 51607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagttcaggagtacaagtc

SEQ ID NO: 51608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagttcaggagtacaagtcc

SEQ ID NO: 51609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaagtccaggtttgttaca

SEQ ID NO: 51610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagtccaggtttgttacat

SEQ ID NO: 51611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acataggtaaacttgtgtca

SEQ ID NO: 51612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cataggtaaacttgtgtcat

SEQ ID NO: 51613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataggtaaacttgtgtcatg

SEQ ID NO: 51614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggtaaacttgtgtcatgg

SEQ ID NO: 51615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtcatgggggtttgtttta

SEQ ID NO: 51616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttacagcttatttcatcacc

SEQ ID NO: 51617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacagcttatttcatcaccc

SEQ ID NO: 51618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatttcatcacccaggtat

SEQ ID NO: 51619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcacccaggtattagacc

SEQ ID NO: 51620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtattagacctagtactcat

SEQ ID NO: 51621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaccctctactgtatttga

SEQ ID NO: 51622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caccctctactgtatttgaa

SEQ ID NO: 51623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctactgtatttgaaaggttc

SEQ ID NO: 51624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctctatgtgtctcacttat

SEQ ID NO: 51625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgtgtctcacttataagc

SEQ ID NO: 51626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatatatgcatttttattt

SEQ ID NO: 51627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtatgttatacttaatgaa

SEQ ID NO: 51628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacttaatgaaaagttaaa

SEQ ID NO: 51629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttctttttctgaaaactc

SEQ ID NO: 51630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttctgaaaactcaagtt

SEQ ID NO: 51631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttctgaaaactcaagttga

SEQ ID NO: 51632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtactaaaatatacacta

SEQ ID NO: 51633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtactaaaatatacactaa

SEQ ID NO: 51634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaaaatatacactaaagg

SEQ ID NO: 51635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacactaaaggaagtactt

SEQ ID NO: 51636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacactaaaggaagtacttt

SEQ ID NO: 51637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaaaggaagtactttagg

SEQ ID NO: 51638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaggaagtactttaggcag

SEQ ID NO: 51639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaagtactttaggcaga

SEQ ID NO: 51640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtactttaggcagaaggaa

SEQ ID NO: 51641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggcagaaggaaaagatct

SEQ ID NO: 51642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaaaagatcttagacaaa

SEQ ID NO: 51643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagatcttagacaaaaagaa

SEQ ID NO: 51644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agacaaaaagaatggaaaca

SEQ ID NO: 51645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaagaatggaaacacagc

SEQ ID NO: 51646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaaacacagcaagaaatg

SEQ ID NO: 51647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcaagaaatgaagaatat

SEQ ID NO: 51648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaatgaagaatattagaa

SEQ ID NO: 51649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatgaagaatattagaat

SEQ ID NO: 51650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataggcgcctgtttacatgt

SEQ ID NO: 51651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggcgcctgtttacatgta

SEQ ID NO: 51652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtttacatgtaaggaaaaa

SEQ ID NO: 51653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggaaaaatggactctaca

SEQ ID NO: 51654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggaaaaatggactctacaa

SEQ ID NO: 51655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtgaaaaatgactacaca

SEQ ID NO: 51656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgactacacaaagcaat

SEQ ID NO: 51657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgactacacaaagcaata

SEQ ID NO: 51658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaataaggtttatgtttta

SEQ ID NO: 51659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatggttttcaaaactata

SEQ ID NO: 51660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatggttttcaaaactatat

SEQ ID NO: 51661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatataggttaaaatgcatt

SEQ ID NO: 51662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttgactttcaattattt

SEQ ID NO: 51663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattttagtctacaacattt

SEQ ID NO: 51664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacatttgagtgatttaat

SEQ ID NO: 51665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgagtgatttaattggta

SEQ ID NO: 51666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attggtaaagtaattgctct

SEQ ID NO: 51667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttggtaaagtaattgctctc

SEQ ID NO: 51668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaattttttctctgttgtg

SEQ ID NO: 51669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcccttaatgtacaata

SEQ ID NO: 51670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaattatttttttacaa

SEQ ID NO: 51671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattatttttttacaaaag

SEQ ID NO: 51672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaagtagccttattttga

SEQ ID NO: 51673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accttttaataactgaaaat

SEQ ID NO: 51674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaataactgaaaattaga

SEQ ID NO: 51675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaattagaaagcgatctt

SEQ ID NO: 51676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaagcgatcttaagtgac

SEQ ID NO: 51677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgccatcataataacttgc

SEQ ID NO: 51678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taacttgctagcacaattaa

SEQ ID NO: 51679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctagcacaattaacagaatg

SEQ ID NO: 51680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaattaacagaatgtagtt

SEQ ID NO: 51681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttctttattaaactacaa

SEQ ID NO: 51682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattaaactacaaaagatta

SEQ ID NO: 51683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaaaatgcctaaatattat

SEQ ID NO: 51684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaattaccaaaacaaaatg

SEQ ID NO: 51685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaattaccaaaacaaaatga

SEQ ID NO: 51686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaccaaaacaaaatgaagg

SEQ ID NO: 51687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaaggtagtcttgatttt

SEQ ID NO: 51688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaggtagtcttgatttta

SEQ ID NO: 51689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattttaaggtttacccccg

SEQ ID NO: 51690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaggtttacccccgcagc

SEQ ID NO: 51691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagcaagttatgaaaataa

SEQ ID NO: 51692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatactgatattcctttaa

SEQ ID NO: 51693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatactgatattcctttaat

SEQ ID NO: 51694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcattttacttactcttcaa

SEQ ID NO: 51695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acactttattgtgtatattt

SEQ ID NO: 51696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactttattgtgtatattta

SEQ ID NO: 51697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtatacaacatgatgctat

SEQ ID NO: 51698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatgctattggatacatg

SEQ ID NO: 51699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctattggatacatgtaga

SEQ ID NO: 51700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacatgtagatagtaaaaaa

SEQ ID NO: 51701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatgtagatagtaaaaaaa

SEQ ID NO: 51702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtaaaaaaaaggttacca

SEQ ID NO: 51703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaggttaccatagta

SEQ ID NO: 51704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaggttaccatagtaa

SEQ ID NO: 51705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaacatatctaccatctc

SEQ ID NO: 51706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgttgtttgttattgt

SEQ ID NO: 51707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttgttgtttgttattgtt

SEQ ID NO: 51708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgttgtttgttattgttg

SEQ ID NO: 51709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgttgtttgttattgttgg

SEQ ID NO: 51710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgttgtttgttattgttggg

SEQ ID NO: 51711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttgtttgttattgttgggg

SEQ ID NO: 51712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtttgttattgttggggg

SEQ ID NO: 51713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtttgttattgttgggggg

SEQ ID NO: 51714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggggggttgttgttgttgtt

SEQ ID NO: 51715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggggttgttgttgttgtttg

SEQ ID NO: 51716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggttgttgttgttgtttgg

SEQ ID NO: 51717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttgttgttgtttggaggt

SEQ ID NO: 51718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgttgttgtttggaggtaa

SEQ ID NO: 51719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagagcaacaaatattttt

SEQ ID NO: 51720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagagcaacaaatattttta

SEQ ID NO: 51721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaaatatttttaaggtgc

SEQ ID NO: 51722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaatatttttaaggtgcc

SEQ ID NO: 51723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttaaggtgccaggtgcc

SEQ ID NO: 51724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttaaggtgccaggtgcct

SEQ ID NO: 51725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctgggacacaatactaac

SEQ ID NO: 51726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctgggacacaatactaact

SEQ ID NO: 51727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggacacaatactaactagg

SEQ ID NO: 51728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggccttgatccttgtcctc

SEQ ID NO: 51729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggccttgatccttgtcctct

SEQ ID NO: 51730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccttgatccttgtcctcta

SEQ ID NO: 51731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccttgtcctctagggctta

SEQ ID NO: 51732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctagggcttacagtctgt

SEQ ID NO: 51733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctagggcttacagtctgtt

SEQ ID NO: 51734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctagggcttacagtctgttg

SEQ ID NO: 51735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacagtctgttggggaaaac

SEQ ID NO: 51736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtctgttggggaaaaccag

SEQ ID NO: 51737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtctgttggggaaaaccagc

SEQ ID NO: 51738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacaacacacctactatat

SEQ ID NO: 51739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaacacacctactatatga

SEQ ID NO: 51740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctactatatgagagcaat

SEQ ID NO: 51741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgagagcaatgagaacaca

SEQ ID NO: 51742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaatgagaacacacagaa

SEQ ID NO: 51743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaatgagaacacacagaaa

SEQ ID NO: 51744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacagaaaaggcacctaact

SEQ ID NO: 51745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaggcacctaacttggact

SEQ ID NO: 51746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggcacctaacttggactt

SEQ ID NO: 51747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacctaacttggacttagg

SEQ ID NO: 51748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaacttggacttaggaaga

SEQ ID NO: 51749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggacttaggaagaaagattt

SEQ ID NO: 51750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaggaagaaagattttggt

SEQ ID NO: 51751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggaagaaagattttggtc

SEQ ID NO: 51752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggaagaaagattttggtca

SEQ ID NO: 51753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaagattttggtcaggg

SEQ ID NO: 51754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaagattttggtcaggga

SEQ ID NO: 51755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagattttggtcagggaagg

SEQ ID NO: 51756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttggtcagggaaggaagat

SEQ ID NO: 51757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcagggaaggaagatgag

SEQ ID NO: 51758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagatgagtagaaatttgc

SEQ ID NO: 51759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgctggtctgtactatga

SEQ ID NO: 51760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgctggtctgtactatgac

SEQ ID NO: 51761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcctccctcttgtgttaa

SEQ ID NO: 51762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaacagtttgctatgatc

SEQ ID NO: 51763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaacagtttgctatgatcc

SEQ ID NO: 51764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacagtttgctatgatccag

SEQ ID NO: 51765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagctgtctccttcatttt

SEQ ID NO: 51766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatttttggctttgtcatc

SEQ ID NO: 51767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactctcaacttttccaaac

SEQ ID NO: 51768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaagaaaaaaaatcatctt

SEQ ID NO: 51769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttggctttgtccttcga

SEQ ID NO: 51770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcgatggaatttgaaatata

SEQ ID NO: 51771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatagcttcataaactctc

SEQ ID NO: 51772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctattcctgtacttgtc

SEQ ID NO: 51773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattctaattaaaaatttta

SEQ ID NO: 51774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctaattaaaaattttaa

SEQ ID NO: 51775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattttaaaggatgcaca

SEQ ID NO: 51776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagcttattttccttcta

SEQ ID NO: 51777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagcttattttccttctaa

SEQ ID NO: 51778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcataacttacttgtattg

SEQ ID NO: 51779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtggataatatcaacca

SEQ ID NO: 51780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accaaagttcctgcattcta

SEQ ID NO: 51781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacagatttttttaacctc

SEQ ID NO: 51782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttttttaacctcaagttc

SEQ ID NO: 51783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttttaacctcaagttcc

SEQ ID NO: 51784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagttccaggttaaattcc

SEQ ID NO: 51785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggttaaattcccagtttg

SEQ ID NO: 51786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtggccaattgttatcat

SEQ ID NO: 51787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgttatcattggccatgca

SEQ ID NO: 51788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtttttcattcccatgct

SEQ ID NO: 51789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtttgtttttatttact

SEQ ID NO: 51790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactaagcactatgattta

SEQ ID NO: 51791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcactatgatttaaagtact

SEQ ID NO: 51792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaactactgcataatattc

SEQ ID NO: 51793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatattccagtgtatattac

SEQ ID NO: 51794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttacctatttgctctct

SEQ ID NO: 51795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctctcttagtgataacacc

SEQ ID NO: 51796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgataacacctggcaatc

SEQ ID NO: 51797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataacacctggcaatccag

SEQ ID NO: 51798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagcagtccccaaccttct

SEQ ID NO: 51799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccccaaccttcttggaacc

SEQ ID NO: 51800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccaaccttcttggaacca

SEQ ID NO: 51801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accttcttggaaccaaggac

SEQ ID NO: 51802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaccaaggactggtttca

SEQ ID NO: 51803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaaggactggtttcatgg

SEQ ID NO: 51804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcatggaagacaatttttt

SEQ ID NO: 51805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatggaagacaattttttc

SEQ ID NO: 51806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catggaagacaattttttca

SEQ ID NO: 51807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaagacaattttttcaggg

SEQ ID NO: 51808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agacaattttttcagggcag

SEQ ID NO: 51809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaattttttcagggcagc

SEQ ID NO: 51810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaattttttcagggcagca

SEQ ID NO: 51811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttttcagggcagcaggg

SEQ ID NO: 51812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttttcagggcagcaggga

SEQ ID NO: 51813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttcagggcagcagggaag

SEQ ID NO: 51814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcagggcagcagggaagg

SEQ ID NO: 51815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagggcagcagggaaggagg

SEQ ID NO: 51816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggcagcagggaaggaggt

SEQ ID NO: 51817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagggaaggaggtaggttt

SEQ ID NO: 51818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagggaaggaggtaggtttt

SEQ ID NO: 51819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggacgaaactattccactt

SEQ ID NO: 51820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actattccacttcagatgat

SEQ ID NO: 51821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctattccacttcagatgatc

SEQ ID NO: 51822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacttcagatgatcaggcat

SEQ ID NO: 51823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcagatgatcaggcattagt

SEQ ID NO: 51824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatgatcaggcattagtta

SEQ ID NO: 51825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcattagttagagtctcat

SEQ ID NO: 51826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcattagttagagtctcata

SEQ ID NO: 51827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attagttagagtctcataag

SEQ ID NO: 51828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcataaggagtgtgcaact

SEQ ID NO: 51829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttagatccctcgtatgtg

SEQ ID NO: 51830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtatgtgcagttcacaata

SEQ ID NO: 51831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataaagcttgcacttctct

SEQ ID NO: 51832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaagcttgcacttctctga

SEQ ID NO: 51833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctctgagagtctaatgcc

SEQ ID NO: 51834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctgagagtctaatgcca

SEQ ID NO: 51835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatgccaaggctgatctaa

SEQ ID NO: 51836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgccaaggctgatctaac

SEQ ID NO: 51837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgccaaggctgatctaacag

SEQ ID NO: 51838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccaaggctgatctaacagg

SEQ ID NO: 51839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggctgatctaacaggagg

SEQ ID NO: 51840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctaacaggaggaagaact

SEQ ID NO: 51841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctaacaggaggaagaactc

SEQ ID NO: 51842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaggaggaagaactcagg

SEQ ID NO: 51843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actcaggtggtaatgttcac

SEQ ID NO: 51844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcaggtggtaatgttcact

SEQ ID NO: 51845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctgctcacctcctgctgtg

SEQ ID NO: 51846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacctcctgctgtgcagcc

SEQ ID NO: 51847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtgcagcctggttcctaa

SEQ ID NO: 51848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgcagcctggttcctaac

SEQ ID NO: 51849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctggttcctaacaggcca

SEQ ID NO: 51850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcctaacaggccatggac

SEQ ID NO: 51851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catggaccagtatctgtcac

SEQ ID NO: 51852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accagtatctgtcactggcc

SEQ ID NO: 51853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccagtatctgtcactggccc

SEQ ID NO: 51854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagtatctgtcactggccca

SEQ ID NO: 51855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtatctgtcactggcccag

SEQ ID NO: 51856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgtcactggcccagggga

SEQ ID NO: 51857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acccctgatctaacccactg

SEQ ID NO: 51858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccactgtggcctataaa

SEQ ID NO: 51859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtggcctataaacagatc

SEQ ID NO: 51860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtggcctataaacagatcc

SEQ ID NO: 51861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaacagatccaggtttta

SEQ ID NO: 51862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atccaggttttatggatctg

SEQ ID NO: 51863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggatctgtggcttatacaac

SEQ ID NO: 51864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatctgtggcttatacaact

SEQ ID NO: 51865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atctgtggcttatacaactg

SEQ ID NO: 51866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctgtggcttatacaactgg

SEQ ID NO: 51867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtggcttatacaactgggg

SEQ ID NO: 51868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtggcttatacaactggggg

SEQ ID NO: 51869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcttatacaactgggggag

SEQ ID NO: 51870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcttatacaactgggggagg

SEQ ID NO: 51871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacaactgggggaggaggtt

SEQ ID NO: 51872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaaaaaatgcaaaaatac

SEQ ID NO: 51873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaaaaatgcaaaaataca

SEQ ID NO: 51874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaaaatgcaaaaatacaa

SEQ ID NO: 51875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaaaatacaagggcaaat

SEQ ID NO: 51876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaatacaagggcaaatt

SEQ ID NO: 51877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagggcaaattaggcacaa

SEQ ID NO: 51878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcaaattaggcacaaaaga

SEQ ID NO: 51879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaagacagattaatataa

SEQ ID NO: 51880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagtgaatgtttattaa

SEQ ID NO: 51881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgaatgtttattaaaagt

SEQ ID NO: 51882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtgagaacaaaaattaaat

SEQ ID NO: 51883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactccttaacacatttctt

SEQ ID NO: 51884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actccttaacacatttcttt

SEQ ID NO: 51885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaggacttcccttcatttt

SEQ ID NO: 51886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actttgtatcaattttgtaa

SEQ ID NO: 51887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgtatcaattttgtaatg

SEQ ID NO: 51888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatcaattttgtaatggag

SEQ ID NO: 51889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caattttgtaatggagaaga

SEQ ID NO: 51890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggagaagatagaaaaatt

SEQ ID NO: 51891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtctttcttttaccacaact

SEQ ID NO: 51892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttttaccacaactgagta

SEQ ID NO: 51893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtgtatgttcattactga

SEQ ID NO: 51894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgttcattactgatagtt

SEQ ID NO: 51895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagttgagcaaatttctct

SEQ ID NO: 51896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagttttacaacttgtttt

SEQ ID NO: 51897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacaacttgtttttggtaa

SEQ ID NO: 51898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtaatggcatgaaaatttt

SEQ ID NO: 51899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcagtattactgtcaaatt

SEQ ID NO: 51900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcagtattactgtcaaattt

SEQ ID NO: 51901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttgggaacacctccatc

SEQ ID NO: 51902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaagtttctttcacatat

SEQ ID NO: 51903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctttcacatatgagttgt

SEQ ID NO: 51904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatatgagttgtaagatat

SEQ ID NO: 51905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatgagttgtaagatatca

SEQ ID NO: 51906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaagatatcagagcctgta

SEQ ID NO: 51907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctgtacagtgtccttatt

SEQ ID NO: 51908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtacagtgtccttattcag

SEQ ID NO: 51909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttatcaatatcctcaatg

SEQ ID NO: 51910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctcaatgtagtgatgtatg

SEQ ID NO: 51911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaatgtagtgatgtatgaa

SEQ ID NO: 51912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttgttatctcaacatgtt

SEQ ID NO: 51913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacatgtttggccatttta

SEQ ID NO: 51914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggccattttatggcaaat

SEQ ID NO: 51915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccattttatggcaaatgagc

SEQ ID NO: 51916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attcactcttctttataaac

SEQ ID NO: 51917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actggattattacacaatcc

SEQ ID NO: 51918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatccaagaatttatttaa

SEQ ID NO: 51919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttatttaatagtgctat

SEQ ID NO: 51920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatttaatagtgctataa

SEQ ID NO: 51921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaatagtgctataagagat

SEQ ID NO: 51922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatgagtgtcttcttcttt

SEQ ID NO: 51923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atactttttacttttgcttc

SEQ ID NO: 51924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtatgacaaaactttgtta

SEQ ID NO: 51925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcactactttaatataaa

SEQ ID NO: 51926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaaagtcaaaaatgaca

SEQ ID NO: 51927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atccaatcttccttcttatc

SEQ ID NO: 51928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccttcttatctagaatgaa

SEQ ID NO: 51929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttcttatctagaatgaac

SEQ ID NO: 51930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggtatttcccattgtgtg

SEQ ID NO: 51931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtatttcccattgtgtgtag

SEQ ID NO: 51932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccattgtgtgtagtggtga

SEQ ID NO: 51933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgtagtggtgatggaatt

SEQ ID NO: 51934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtagtggtgatggaattca

SEQ ID NO: 51935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagagccttgacacctgccg

SEQ ID NO: 51936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccttgacacctgccgtgga

SEQ ID NO: 51937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacctgccgtggaaagcta

SEQ ID NO: 51938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggaaagctaaagtgacta

SEQ ID NO: 51939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattccactcctgttatttt

SEQ ID NO: 51940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccactcctgttattttaag

SEQ ID NO: 51941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcctgttattttaagtggt

SEQ ID NO: 51942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctgttattttaagtggtg

SEQ ID NO: 51943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtgaggccatcatctcct

SEQ ID NO: 51944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctcctaagcttattcaaa

SEQ ID NO: 51945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgccctttactttgaact

SEQ ID NO: 51946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactttgaacttggtgaatg

SEQ ID NO: 51947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggtgaatgaagccaaata

SEQ ID NO: 51948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtgaatgaagccaaataa

SEQ ID NO: 51949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaatgaagccaaataaagg

SEQ ID NO: 51950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttattgaaattcccttgtgc

SEQ ID NO: 51951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattgaaattcccttgtgct

SEQ ID NO: 51952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttgtgctgggtctatgta

SEQ ID NO: 51953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctgggtctatgtacagcta

SEQ ID NO: 51954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggtctatgtacagctatag

SEQ ID NO: 51955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctatagtagaatcctgtg

SEQ ID NO: 51956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatagtagaatcctgtgtgg

SEQ ID NO: 51957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtagaatcctgtgtggcag

SEQ ID NO: 51958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctgtgtggcagcagtgac

SEQ ID NO: 51959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgtggcagcagtgaccag

SEQ ID NO: 51960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcagcagtgaccagtagtc

SEQ ID NO: 51961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagtgaccagtagtctagc

SEQ ID NO: 51962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaccagtagtctagccagc

SEQ ID NO: 51963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaccagtagtctagccagct

SEQ ID NO: 51964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agccagctgggtctgccaaa

SEQ ID NO: 51965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgggtctgccaaacagcctc

SEQ ID NO: 51966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctctagatttcccttttgt

SEQ ID NO: 51967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtcagctcattttcctata

SEQ ID NO: 51968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttcctatacagctgctc

SEQ ID NO: 51969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagctgctctagtttccca

SEQ ID NO: 51970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagccttccaatgaatgcat

SEQ ID NO: 51971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttccaataaatctccatt

SEQ ID NO: 51972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caataaatctccatttggct

SEQ ID NO: 51973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aataaatctccatttggctt

SEQ ID NO: 51974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctccatttggcttggga

SEQ ID NO: 51975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccatttggcttgggacagc

SEQ ID NO: 51976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaatatctttgcttaatat

SEQ ID NO: 51977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaatatgagaaattacttt

SEQ ID NO: 51978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attacttttggctcactttg

SEQ ID NO: 51979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttacttttggctcactttgt

SEQ ID NO: 51980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggctcactttgtgggaac

SEQ ID NO: 51981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggctcactttgtgggaact

SEQ ID NO: 51982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactaggttatgaccaaaac

SEQ ID NO: 51983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaccaaaacaagctccttt

SEQ ID NO: 51984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagctccttttggctatga

SEQ ID NO: 51985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggctatgacagttttgct

SEQ ID NO: 51986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagttttgctaagtgatta

SEQ ID NO: 51987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaattaatcacttgacct

SEQ ID NO: 51988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaatcacttgacctcag

SEQ ID NO: 51989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatcacttgacctcagaag

SEQ ID NO: 51990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctcagaagtagtgatttaa

SEQ ID NO: 51991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttaaaagaaacataatg

SEQ ID NO: 51992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cataatgcagtctgtaaatg

SEQ ID NO: 51993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacttcttatactataaaa

SEQ ID NO: 51994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatatttctgcaatatcca

SEQ ID NO: 51995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagtccaaaacttttattt

SEQ ID NO: 51996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaacttttattttggact

SEQ ID NO: 51997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttctacactattattct

SEQ ID NO: 51998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtttttaaaaatgaaatca

SEQ ID NO: 51999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgtaaatataacaaaacc

SEQ ID NO: 52000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagccattatttaatcttg

SEQ ID NO: 52001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagccattatttaatcttgc

SEQ ID NO: 52002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttaatcttgcaggaccat

SEQ ID NO: 52003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggaccataagccttccat

SEQ ID NO: 52004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaaatatttttgtcctc

SEQ ID NO: 52005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgtcctcaagaaaata

SEQ ID NO: 52006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagaaaatatggcaaatcc

SEQ ID NO: 52007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaagaatatatttatttt

SEQ ID NO: 52008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttattttaagaaatataaa

SEQ ID NO: 52009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaatataaatagtataata

SEQ ID NO: 52010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttattaaataataattgt

SEQ ID NO: 52011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgctataatattttatct

SEQ ID NO: 52012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattttatcttggtctaaac

SEQ ID NO: 52013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatcttggtctaaaccag

SEQ ID NO: 52014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaaaccagtggtcctcaa

SEQ ID NO: 52015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaaccagtggtcctcaac

SEQ ID NO: 52016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggataattcttccctacctc

SEQ ID NO: 52017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataattcttccctacctcc

SEQ ID NO: 52018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattcttccctacctccagg

SEQ ID NO: 52019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttccctacctccaggtg

SEQ ID NO: 52020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctacctccaggtggagttac

SEQ ID NO: 52021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctccaggtggagttacca

SEQ ID NO: 52022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaggtggagttaccagagt

SEQ ID NO: 52023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagttaccagagttagcaaa

SEQ ID NO: 52024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagttagcaaaaagaataca

SEQ ID NO: 52025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagcaaaaagaatacacagt

SEQ ID NO: 52026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacatattctgaccataaa

SEQ ID NO: 52027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cataaatggaaatgttttta

SEQ ID NO: 52028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggaaatgtttttacagaa

SEQ ID NO: 52029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttatctaaaataaatgat

SEQ ID NO: 52030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaatgatcagtatgtaaat

SEQ ID NO: 52031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgatcagtatgtaaatta

SEQ ID NO: 52032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaaaatttcctcgatgat

SEQ ID NO: 52033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgatgattggctttcattaa

SEQ ID NO: 52034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaacagctccttgttttg

SEQ ID NO: 52035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacagctccttgttttgca

SEQ ID NO: 52036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgacttataaaattcctta

SEQ ID NO: 52037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaaattccttatagtta

SEQ ID NO: 52038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaatgtaacatgtcttcca

SEQ ID NO: 52039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtaacatgtcttccatag

SEQ ID NO: 52040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccattcaacattcattaat

SEQ ID NO: 52041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattaatgagaacatcgtg

SEQ ID NO: 52042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgagaacatcgtgaagtc

SEQ ID NO: 52043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcgtgaagtccagcttat

SEQ ID NO: 52044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaagtccagcttataagtc

SEQ ID NO: 52045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccagcttattgaacatgtt

SEQ ID NO: 52046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattgaacatgttcagtgt

SEQ ID NO: 52047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttcagtgttagccttat

SEQ ID NO: 52048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagtgttagccttataagc

SEQ ID NO: 52049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgaacatgtattgactta

SEQ ID NO: 52050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattgacttaaagttaactc

SEQ ID NO: 52051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgacttaaagttaactct

SEQ ID NO: 52052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggacttactcttttgcta

SEQ ID NO: 52053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttgtttttttttattttt

SEQ ID NO: 52054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgtttttttttatttttc

SEQ ID NO: 52055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttttatttttcaggat

SEQ ID NO: 52056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatattttccactgacaaaa

SEQ ID NO: 52057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatttttattcccttcttt

SEQ ID NO: 52058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatttctcctgttccatta

SEQ ID NO: 52059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttctcctgttccattaa

SEQ ID NO: 52060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaaaggatcaaattcttc

SEQ ID NO: 52061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaggatcaaattcttca

SEQ ID NO: 52062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaggatcaaattcttcaa

SEQ ID NO: 52063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aataattatccacttcaata

SEQ ID NO: 52064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cggactttttccctgtccct

SEQ ID NO: 52065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtgttgttcctcttaaaa

SEQ ID NO: 52066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttcctcttaaaacagcct

SEQ ID NO: 52067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaacagccttggcatac

SEQ ID NO: 52068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaacagccttggcataca

SEQ ID NO: 52069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaacagccttggcatacaa

SEQ ID NO: 52070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacattcaacaactctttgt

SEQ ID NO: 52071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacaactctttgtaagcaa

SEQ ID NO: 52072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaactctttgtaagcaatg

SEQ ID NO: 52073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caactctttgtaagcaatgg

SEQ ID NO: 52074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactctttgtaagcaatgga

SEQ ID NO: 52075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcataatcctattgctaa

SEQ ID NO: 52076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatcctattgctaaaagata

SEQ ID NO: 52077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaagatatggaatgctat

SEQ ID NO: 52078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatatggaatgctatgagc

SEQ ID NO: 52079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgctatgagcaagaaat

SEQ ID NO: 52080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctatgagcaagaaataag

SEQ ID NO: 52081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataagtagtctttactcaa

SEQ ID NO: 52082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataagtagtctttactcaat

SEQ ID NO: 52083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactcaatgggttattttaa

SEQ ID NO: 52084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatgggttattttaaaagt

SEQ ID NO: 52085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggttattttaaaagtcagc

SEQ ID NO: 52086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaagtcagcaagaatttgt

SEQ ID NO: 52087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttgtgagaccttttctt

SEQ ID NO: 52088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaccttttcttcagaatta

SEQ ID NO: 52089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcagaattaaagtatgattt

SEQ ID NO: 52090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcggtgctttaaataaact

SEQ ID NO: 52091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctcaactgcatctatta

SEQ ID NO: 52092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcaactgcatctattaaa

SEQ ID NO: 52093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaactgcatctattaaaga

SEQ ID NO: 52094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcatctattaaagagagc

SEQ ID NO: 52095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtgaattttaaaatgtga

SEQ ID NO: 52096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattacaaaaattcttcat

SEQ ID NO: 52097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacaaaaattcttcattag

SEQ ID NO: 52098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaaaattcttcattagta

SEQ ID NO: 52099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttcattagtagagtctgaa

SEQ ID NO: 52100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaacagaataaatgctgaaa

SEQ ID NO: 52101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcttgacaatttctttac

SEQ ID NO: 52102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcaattactttactgatat

SEQ ID NO: 52103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actgatatcagatgctgttt

SEQ ID NO: 52104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatatcagatgctgtttgag

SEQ ID NO: 52105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctgtttgagcagcgtcatg

SEQ ID NO: 52106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagcagcgtcatgtagaata

SEQ ID NO: 52107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagcgtcatgtagaatatgg

SEQ ID NO: 52108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtcatgtagaatatggcag

SEQ ID NO: 52109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatgtagaatatggcagaa

SEQ ID NO: 52110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgtagaatatggcagaag

SEQ ID NO: 52111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaagaggcaacactgttca

SEQ ID NO: 52112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtattacctccacaaaat

SEQ ID NO: 52113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgactactaactcaatca

SEQ ID NO: 52114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgactactaactcaatcat

SEQ ID NO: 52115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgactactaactcaatcata

SEQ ID NO: 52116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaatttcttgttgtttctg

SEQ ID NO: 52117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgtttctgaagactcatc

SEQ ID NO: 52118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttctgaagactcatctgg

SEQ ID NO: 52119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttctgaagactcatctgga

SEQ ID NO: 52120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctggaaggcgtgttacaa

SEQ ID NO: 52121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcgtgttacaatagccttgt

SEQ ID NO: 52122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttacaatagccttgtaagc

SEQ ID NO: 52123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtaagcaagtctttttat

SEQ ID NO: 52124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatgagaaaattattatac

SEQ ID NO: 52125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaattattatacgagta

SEQ ID NO: 52126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaattattatacgagtaa

SEQ ID NO: 52127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgtgattacttgcattca

SEQ ID NO: 52128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcatggctatgccataaaa

SEQ ID NO: 52129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataaaaaagtaaaacattt

SEQ ID NO: 52130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagtaaaacatttgagctg

SEQ ID NO: 52131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctgtggtaatctctgtaa

SEQ ID NO: 52132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaatctctgtaacagtaaa

SEQ ID NO: 52133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatctctgtaacagtaaatg

SEQ ID NO: 52134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agttattctaatttttatta

SEQ ID NO: 52135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattctaatttttattacgg

SEQ ID NO: 52136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaatttttattacggcag

SEQ ID NO: 52137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cggcagtagattttgtccta

SEQ ID NO: 52138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagattttgtcctatagcac

SEQ ID NO: 52139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgcattaaaaaatacttg

SEQ ID NO: 52140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgtagcacaattcaaatt

SEQ ID NO: 52141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caattcaaattaagtcatgt

SEQ ID NO: 52142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaccttgtatgatataca

SEQ ID NO: 52143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accttgtatgatatacaaag

SEQ ID NO: 52144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtatgatatacaaagtgg

SEQ ID NO: 52145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatctgaatttctttcaat

SEQ ID NO: 52146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgattttattactttctt

SEQ ID NO: 52147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttattactttctttggtac

SEQ ID NO: 52148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactttctttggtacaagtt

SEQ ID NO: 52149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actttctttggtacaagttg

SEQ ID NO: 52150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatcatacatctatttgct

SEQ ID NO: 52151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatctatttgcttagctgt

SEQ ID NO: 52152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcttagctgttagtatttgc

SEQ ID NO: 52153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatttgctggcttacatcc

SEQ ID NO: 52154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttcaccattttcaatat

SEQ ID NO: 52155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaattgtatgctgcaca

SEQ ID NO: 52156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaattgtatgctgcacaaa

SEQ ID NO: 52157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctgcacaaagagcttcaa

SEQ ID NO: 52158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctgcacaaagagcttcaaa

SEQ ID NO: 52159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcacaaagagcttcaaaag

SEQ ID NO: 52160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acttgcattttgacattttt

SEQ ID NO: 52161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttctacacaaataaaaaa

SEQ ID NO: 52162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaaataaaaaatggatat

SEQ ID NO: 52163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggatattagtaattgacc

SEQ ID NO: 52164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggatattagtaattgaccc

SEQ ID NO: 52165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattgacccaggaattgaa

SEQ ID NO: 52166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattgaatttgataatctca

SEQ ID NO: 52167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcacagctttgtcactgt

SEQ ID NO: 52168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtcactgtcagtcactca

SEQ ID NO: 52169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtcactgtcagtcactcac

SEQ ID NO: 52170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcataactaaacataaac

SEQ ID NO: 52171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcataactaaacataaacaa

SEQ ID NO: 52172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actaaacataaacaagagtt

SEQ ID NO: 52173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaagagttgagccaatga

SEQ ID NO: 52174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaagagttgagccaatgaa

SEQ ID NO: 52175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgcaaacttgtgaactta

SEQ ID NO: 52176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagtaaattgaactaaatat

SEQ ID NO: 52177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctaaacgttctgtttgc

SEQ ID NO: 52178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaacgttctgtttgccagc

SEQ ID NO: 52179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacgttctgtttgccagcaa

SEQ ID NO: 52180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgttctgtttgccagcaaga

SEQ ID NO: 52181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagagagaactgtatttgt

SEQ ID NO: 52182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagagaactgtatttgtga

SEQ ID NO: 52183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaactgtatttgtgagagat

SEQ ID NO: 52184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttgtgagagataagttcc

SEQ ID NO: 52185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagataagttcctggaaca

SEQ ID NO: 52186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagttcctggaacaaagcca

SEQ ID NO: 52187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccacagctgacattatat

SEQ ID NO: 52188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccacagctgacattatata

SEQ ID NO: 52189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctgacattatataaggtt

SEQ ID NO: 52190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctgacattatataaggttt

SEQ ID NO: 52191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgacattatataaggtttg

SEQ ID NO: 52192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaggtttggggaaatgtg

SEQ ID NO: 52193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggtttggggaaatgtgca

SEQ ID NO: 52194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggggaaatgtgcagagtgtt

SEQ ID NO: 52195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaatgtgcagagtgttta

SEQ ID NO: 52196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcagagtgtttagagactc

SEQ ID NO: 52197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagagtgtttagagactca

SEQ ID NO: 52198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagagactcaaggacttc

SEQ ID NO: 52199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaggacttccagctgtgt

SEQ ID NO: 52200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacttccagctgtgttagtg

SEQ ID NO: 52201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctgtgttagtgtggacac

SEQ ID NO: 52202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtgttagtgtggacactg

SEQ ID NO: 52203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttagtgtggacactggagt

SEQ ID NO: 52204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccgttgaccttctaaattt

SEQ ID NO: 52205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttctaaattttggaaaca

SEQ ID NO: 52206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattttggaaacatggtcac

SEQ ID NO: 52207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttggaaacatggtcacta

SEQ ID NO: 52208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggaaacatggtcactagag

SEQ ID NO: 52209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaaacatggtcactagagt

SEQ ID NO: 52210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagtgggacacttactgat

SEQ ID NO: 52211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttactgattggctgttctc

SEQ ID NO: 52212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggctgttctctagcacca

SEQ ID NO: 52213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggctgttctctagcaccat

SEQ ID NO: 52214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggctgttctctagcaccata

SEQ ID NO: 52215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctgttctctagcaccatag

SEQ ID NO: 52216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttctctagcaccatagggg

SEQ ID NO: 52217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctctagcaccataggggc

SEQ ID NO: 52218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accataggggcaggcactga

SEQ ID NO: 52219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccataggggcaggcactgac

SEQ ID NO: 52220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cataggggcaggcactgaca

SEQ ID NO: 52221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggcactgacagggtgatgtt

SEQ ID NO: 52222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactgacagggtgatgttc

SEQ ID NO: 52223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacagggtgatgttcgggac

SEQ ID NO: 52224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acagggtgatgttcgggact

SEQ ID NO: 52225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggtgatgttcgggactgg

SEQ ID NO: 52226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgggactgggagtttatcat

SEQ ID NO: 52227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gactgggagtttatcattag

SEQ ID NO: 52228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcattagcagactttcaa

SEQ ID NO: 52229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagcagactttcaaaagct

SEQ ID NO: 52230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agactttcaaaagcttggac

SEQ ID NO: 52231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggccttcacttgctaacttt

SEQ ID NO: 52232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcacttgctaactttcag

SEQ ID NO: 52233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgctaactttcagaagca

SEQ ID NO: 52234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actttcagaagcatagttac

SEQ ID NO: 52235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcagaagcatagttactg

SEQ ID NO: 52236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagcatagttactggagt

SEQ ID NO: 52237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagcatagttactggagtg

SEQ ID NO: 52238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatagttactggagtgagg

SEQ ID NO: 52239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgaggcagttattgac

SEQ ID NO: 52240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttattgactggtttatttt

SEQ ID NO: 52241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctggtttattttcagaaaca

SEQ ID NO: 52242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attttcagaaacatggccac

SEQ ID NO: 52243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaacatggccactggaat

SEQ ID NO: 52244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccactggaatgagaatttca

SEQ ID NO: 52245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgagaatttcacagatt

SEQ ID NO: 52246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcacagatttagctgatttt

SEQ ID NO: 52247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagatttagctgattttca

SEQ ID NO: 52248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagcctgtgtactgattct

SEQ ID NO: 52249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctgttcacaacttgaaact

SEQ ID NO: 52250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgttcacaacttgaaactt

SEQ ID NO: 52251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacttgaaacttgggctta

SEQ ID NO: 52252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttcttgaatatgaaaaat

SEQ ID NO: 52253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaatatgaaaaataagca

SEQ ID NO: 52254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgaaaaataagcacagtct

SEQ ID NO: 52255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagcacagtctgagcatgta

SEQ ID NO: 52256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcacagtctgagcatgtaca

SEQ ID NO: 52257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcattatttcctaatgaatg

SEQ ID NO: 52258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagaataacaacaattacat

SEQ ID NO: 52259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taacaacaattacattggat

SEQ ID NO: 52260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacaacaattacattggatt

SEQ ID NO: 52261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacattggattaggtattat

SEQ ID NO: 52262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaggtattataagtaatc

SEQ ID NO: 52263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggtattataagtaatcta

SEQ ID NO: 52264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaatctagagatgattta

SEQ ID NO: 52265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tagagatgatttaaagtata

SEQ ID NO: 52266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatgatttaaagtatacgg

SEQ ID NO: 52267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgatttaaagtatacggt

SEQ ID NO: 52268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtatacggtaggatgtgaa

SEQ ID NO: 52269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttacaccattttatgta

SEQ ID NO: 52270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccattttatgtaaagaactt

SEQ ID NO: 52271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaaagaacttgagcatctc

SEQ ID NO: 52272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttgagcatctccagattt

SEQ ID NO: 52273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagatttcagtatctcat

SEQ ID NO: 52274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccagatttcagtatctcatg

SEQ ID NO: 52275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcagtatctcatgaggtcc

SEQ ID NO: 52276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accaatccctcactgatact

SEQ ID NO: 52277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaatccctcactgatactg

SEQ ID NO: 52278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatccctcactgatactga

SEQ ID NO: 52279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattttctgcctgtgcttt

SEQ ID NO: 52280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtgcttttggtgttccct

SEQ ID NO: 52281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcccttagccaaacctgc

SEQ ID NO: 52282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttagccaaacctgctaga

SEQ ID NO: 52283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttagccaaacctgctagaaa

SEQ ID NO: 52284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagccaaacctgctagaaag

SEQ ID NO: 52285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaacctgctagaaagagga

SEQ ID NO: 52286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacctgctagaaagaggat

SEQ ID NO: 52287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacctgctagaaagaggata

SEQ ID NO: 52288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagaggatagggattgta

SEQ ID NO: 52289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgtaaagattctcatttg

SEQ ID NO: 52290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaaagattctcatttgta

SEQ ID NO: 52291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaaagattctcatttgtag

SEQ ID NO: 52292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttgtagaggtaaacattt

SEQ ID NO: 52293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaacattttggctaatgt

SEQ ID NO: 52294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggctaatgttggcattt

SEQ ID NO: 52295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaatcaccaattactgtcg

SEQ ID NO: 52296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caattactgtcgcagaaaaa

SEQ ID NO: 52297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttgtaatttattgaaaa

SEQ ID NO: 52298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatttattgaaaaaagct

SEQ ID NO: 52299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattgaaaaaagctaagata

SEQ ID NO: 52300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgaaaaaagctaagatac

SEQ ID NO: 52301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagctaagatacaggaaatt

SEQ ID NO: 52302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agctaagatacaggaaattt

SEQ ID NO: 52303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttaggctgtcttgaca

SEQ ID NO: 52304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtcttgacaaagccaata

SEQ ID NO: 52305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtcttgacaaagccaataa

SEQ ID NO: 52306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtcttgacaaagccaataaa

SEQ ID NO: 52307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacaaagccaataaagggtg

SEQ ID NO: 52308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaagccaataaagggtgc

SEQ ID NO: 52309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatcattacatacatttcc

SEQ ID NO: 52310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctagtttcatatactgta

SEQ ID NO: 52311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttcatatactgtatagatat

SEQ ID NO: 52312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatcggactctcctccctca

SEQ ID NO: 52313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcggactctcctccctcat

SEQ ID NO: 52314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcctccctcatgggaaca

SEQ ID NO: 52315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctccctcatgggaacatg

SEQ ID NO: 52316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctccctcatgggaacatgg

SEQ ID NO: 52317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctcatgggaacatggagg

SEQ ID NO: 52318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgggaacatggaggaag

SEQ ID NO: 52319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgggaacatggaggaaga

SEQ ID NO: 52320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgggaacatggaggaagaa

SEQ ID NO: 52321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaagaagggtgcttgcta

SEQ ID NO: 52322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggtgcttgctatggacacc

SEQ ID NO: 52323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcttgctatggacacctgg

SEQ ID NO: 52324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcttgctatggacacctggt

SEQ ID NO: 52325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctatggacacctggtggg

SEQ ID NO: 52326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatggacacctggtgggta

SEQ ID NO: 52327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatggacacctggtgggtag

SEQ ID NO: 52328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacacctggtgggtagagga

SEQ ID NO: 52329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacctggtgggtagaggaca

SEQ ID NO: 52330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctggtgggtagaggacaga

SEQ ID NO: 52331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctggtgggtagaggacagag

SEQ ID NO: 52332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaggacagagaggctgcta

SEQ ID NO: 52333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaggctgctaaagttccta

SEQ ID NO: 52334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggctgctaaagttcctat

SEQ ID NO: 52335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgcccccaaaatcgatt

SEQ ID NO: 52336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccccaaaatcgattaagct

SEQ ID NO: 52337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccaaaatcgattaagctg

SEQ ID NO: 52338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatcgattaagctgaggtt

SEQ ID NO: 52339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggttgagaaacctatgct

SEQ ID NO: 52340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcttagaccacaatttcacc

SEQ ID NO: 52341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttagaccacaatttcacctg

SEQ ID NO: 52342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaccacaatttcacctgg

SEQ ID NO: 52343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttttccatttaacaatgc

SEQ ID NO: 52344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttccatttaacaatgcc

SEQ ID NO: 52345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttccatttaacaatgcca

SEQ ID NO: 52346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaacaatgccagggtcct

SEQ ID NO: 52347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagaacttacttgctcctt

SEQ ID NO: 52348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgctttgtttacactgtaaa

SEQ ID NO: 52349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttacactgtaaacggcct

SEQ ID NO: 52350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacactgtaaacggcctga

SEQ ID NO: 52351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacactgtaaacggcctgag

SEQ ID NO: 52352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtaaacggcctgagaggc

SEQ ID NO: 52353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacggcctgagaggctggc

SEQ ID NO: 52354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacggcctgagaggctggct

SEQ ID NO: 52355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagaggctggctgggtttt

SEQ ID NO: 52356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttagttctatatcttct

SEQ ID NO: 52357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagttctatatcttctga

SEQ ID NO: 52358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagttctatatcttctgag

SEQ ID NO: 52359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatcttctgagaggtattc

SEQ ID NO: 52360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcttctgagaggtattct

SEQ ID NO: 52361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcttccaatatatccacc

SEQ ID NO: 52362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcttccaatatatccacca

SEQ ID NO: 52363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggctaatcactaactgtttt

SEQ ID NO: 52364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttcagttgtaatcattc

SEQ ID NO: 52365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaatcattccagtgtcatc

SEQ ID NO: 52366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccagtgtcatccagtgatt

SEQ ID NO: 52367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatccagtgattaagctct

SEQ ID NO: 52368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgattaagctctaagctt

SEQ ID NO: 52369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagctttggtactcctttta

SEQ ID NO: 52370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttatagtacacttaata

SEQ ID NO: 52371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttatagtacacttaataa

SEQ ID NO: 52372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taataaaggatacctgtgct

SEQ ID NO: 52373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggatacctgtgctgagttg

SEQ ID NO: 52374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtgctgagttgtagaccc

SEQ ID NO: 52375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtgctgagttgtagaccct

SEQ ID NO: 52376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggcattgacactaactcat

SEQ ID NO: 52377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgattattttcattattttt

SEQ ID NO: 52378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gattattttcattattttta

SEQ ID NO: 52379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attattttcattatttttaa

SEQ ID NO: 52380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagggactatttccttaaca

SEQ ID NO: 52381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactatttccttaacaaaga

SEQ ID NO: 52382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatttccttaacaaagaaag

SEQ ID NO: 52383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttccttaacaaagaaagtg

SEQ ID NO: 52384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccttaacaaagaaagtgga

SEQ ID NO: 52385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacaaagaaagtggagaga

SEQ ID NO: 52386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacaaagaaagtggagagaa

SEQ ID NO: 52387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaagaaagtggagagaaa

SEQ ID NO: 52388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaagaaagtggagagaaag

SEQ ID NO: 52389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagaaagtggagagaaagg

SEQ ID NO: 52390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtggagagaaagggggtc

SEQ ID NO: 52391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtggagagaaagggggtcca

SEQ ID NO: 52392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggagagaaagggggtccag

SEQ ID NO: 52393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaaagggggtccagagg

SEQ ID NO: 52394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaaagggggtccagagga

SEQ ID NO: 52395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagggggtccagaggaagg

SEQ ID NO: 52396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggtagatgtatgattttg

SEQ ID NO: 52397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtagatgtatgattttgaa

SEQ ID NO: 52398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatgattttgaagagatt

SEQ ID NO: 52399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgattttgaagagattaag

SEQ ID NO: 52400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgattttgaagagattaagc

SEQ ID NO: 52401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattaagcaggaaaatgatc

SEQ ID NO: 52402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaaaactcacttttcaca

SEQ ID NO: 52403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactcacttttcacatagtc

SEQ ID NO: 52404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcacttttcacatagtcta

SEQ ID NO: 52405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcacttttcacatagtctag

SEQ ID NO: 52406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacttttcacatagtctaga

SEQ ID NO: 52407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtctagagggtaaattta

SEQ ID NO: 52408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctagagggtaaatttacag

SEQ ID NO: 52409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagggtaaatttacagcaga

SEQ ID NO: 52410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaatttacagcagaaagat

SEQ ID NO: 52411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcagaaagatcggttacc

SEQ ID NO: 52412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgaataaaactgatatgat

SEQ ID NO: 52413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaaactgatatgattgg

SEQ ID NO: 52414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataaaactgatatgattggt

SEQ ID NO: 52415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaactgatatgattggtg

SEQ ID NO: 52416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaactgatatgattggtgg

SEQ ID NO: 52417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatatgattggtgggggta

SEQ ID NO: 52418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggggtatggaaacatatt

SEQ ID NO: 52419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggggtatggaaacatattg

SEQ ID NO: 52420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatggaaacatattgaggta

SEQ ID NO: 52421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggaaacatattgaggtat

SEQ ID NO: 52422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catattgaggtataggtatg

SEQ ID NO: 52423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtatgtggttacatttga

SEQ ID NO: 52424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttacatttgaaagataatga

SEQ ID NO: 52425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacatttgaaagataatgaa

SEQ ID NO: 52426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgaaagataatgaaaggc

SEQ ID NO: 52427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agataatgaaaggctggaaa

SEQ ID NO: 52428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatgaaaggctggaaatgg

SEQ ID NO: 52429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctggaaatggcagttgaact

SEQ ID NO: 52430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggaaatggcagttgaactc

SEQ ID NO: 52431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcagttgaactcgggattc

SEQ ID NO: 52432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttgaactcgggattccag

SEQ ID NO: 52433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaactcgggattccagaagt

SEQ ID NO: 52434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggattccagaagtgagat

SEQ ID NO: 52435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaagtgagatgagcatcc

SEQ ID NO: 52436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagcatccaagattacttt

SEQ ID NO: 52437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagcatccaagattactttc

SEQ ID NO: 52438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttactttcaggtatctgact

SEQ ID NO: 52439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtatctgacttggcctgcc

SEQ ID NO: 52440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcctgccaagttaatactc

SEQ ID NO: 52441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atactccagtgatttcttat

SEQ ID NO: 52442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actccagtgatttcttatga

SEQ ID NO: 52443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctccagtgatttcttatgag

SEQ ID NO: 52444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatttcttatgagaggaaac

SEQ ID NO: 52445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttcttatgagaggaaact

SEQ ID NO: 52446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttatgagaggaaactag

SEQ ID NO: 52447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttatgagaggaaactagg

SEQ ID NO: 52448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagaggaaactaggaggat

SEQ ID NO: 52449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaggaaactaggaggatg

SEQ ID NO: 52450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactaggaggatgaggctta

SEQ ID NO: 52451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaggatgaggcttaaagaa

SEQ ID NO: 52452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggatgaggcttaaagaac

SEQ ID NO: 52453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggatgaggcttaaagaaca

SEQ ID NO: 52454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaggcttaaagaacaggg

SEQ ID NO: 52455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaatgataaatccaattt

SEQ ID NO: 52456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttggacatcctgtgttt

SEQ ID NO: 52457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catcctgtgtttgagatgcc

SEQ ID NO: 52458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcctgtgtttgagatgcct

SEQ ID NO: 52459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgtgtttgagatgcctgg

SEQ ID NO: 52460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagatgcctgggagacaca

SEQ ID NO: 52461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatgcctgggagacacaaag

SEQ ID NO: 52462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgggagacacaaagtaga

SEQ ID NO: 52463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgggagacacaaagtagac

SEQ ID NO: 52464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaagtagacaggtccaat

SEQ ID NO: 52465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtagacaggtccaataag

SEQ ID NO: 52466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtagctaaccatgttactc

SEQ ID NO: 52467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttactctggaacttaaaa

SEQ ID NO: 52468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttactctggaacttaaaat

SEQ ID NO: 52469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactctggaacttaaaatgg

SEQ ID NO: 52470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actctggaacttaaaatggg

SEQ ID NO: 52471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggaacttaaaatgggaggc

SEQ ID NO: 52472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaacttaaaatgggaggct

SEQ ID NO: 52473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttaaaatgggaggctgggt

SEQ ID NO: 52474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgggaggctgggttggaaa

SEQ ID NO: 52475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggttggaaatagtaactt

SEQ ID NO: 52476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggttggaaatagtaactttg

SEQ ID NO: 52477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatagtaactttggagacac

SEQ ID NO: 52478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggagacaccagcatata

SEQ ID NO: 52479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggagacaccagcatataaa

SEQ ID NO: 52480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagtattttgacattgcc

SEQ ID NO: 52481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtattttgacattgccc

SEQ ID NO: 52482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acattgcccaggaatattcc

SEQ ID NO: 52483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaggaatattcctagtccc

SEQ ID NO: 52484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaatattcctagtcccaa

SEQ ID NO: 52485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaatattcctagtcccaag

SEQ ID NO: 52486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcctagtcccaagaggctaa

SEQ ID NO: 52487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaagaggctaatggttttt

SEQ ID NO: 52488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggctaatggtttttaaga

SEQ ID NO: 52489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacgtgtacataaatgatca

SEQ ID NO: 52490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgatcatagtacaaaaca

SEQ ID NO: 52491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtacaaaacatggcaaaa

SEQ ID NO: 52492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatggcaaaacagcttgaa

SEQ ID NO: 52493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcaaaacagcttgaatgg

SEQ ID NO: 52494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgaatggaagtattttaa

SEQ ID NO: 52495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagtattttaaaagtacct

SEQ ID NO: 52496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagtaccttggaaacac

SEQ ID NO: 52497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaagtaccttggaaacaca

SEQ ID NO: 52498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagtaccttggaaacacaa

SEQ ID NO: 52499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtaccttggaaacacaag

SEQ ID NO: 52500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accttggaaacacaaggggt

SEQ ID NO: 52501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacacaaggggttagaaat

SEQ ID NO: 52502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggggttagaaattggttt

SEQ ID NO: 52503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggttagaaattggtttgagc

SEQ ID NO: 52504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaattggtttgagctggta

SEQ ID NO: 52505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaattggtttgagctggtat

SEQ ID NO: 52506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtttgagctggtatagga

SEQ ID NO: 52507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgagctggtataggaaag

SEQ ID NO: 52508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgagctggtataggaaaga

SEQ ID NO: 52509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctggtataggaaagaagga

SEQ ID NO: 52510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tataggaaagaaggaaagtt

SEQ ID NO: 52511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaagaaggaaagttgagt

SEQ ID NO: 52512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaaagttgagttggaatt

SEQ ID NO: 52513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagttgagttggaattcag

SEQ ID NO: 52514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgagttggaattcagcaga

SEQ ID NO: 52515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggaattcagcagatggata

SEQ ID NO: 52516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtcgtatgtatatttcta

SEQ ID NO: 52517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtcgtatgtatatttctaa

SEQ ID NO: 52518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatatttctaaaggctgaa

SEQ ID NO: 52519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctaaaggctgaaaagtgc

SEQ ID NO: 52520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaggctgaaaagtgcaagc

SEQ ID NO: 52521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggctgaaaagtgcaagcc

SEQ ID NO: 52522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggctaccttctttttaatc

SEQ ID NO: 52523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccagactccaacactgaa

SEQ ID NO: 52524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agactccaacactgaaaagc

SEQ ID NO: 52525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactccaacactgaaaagct

SEQ ID NO: 52526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgaaaagctaggtcacct

SEQ ID NO: 52527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagctaggtcaccttagtt

SEQ ID NO: 52528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttacttaactgtgtatct

SEQ ID NO: 52529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtgtatctcagtttactcat

SEQ ID NO: 52530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtttactcatcggtaaaat

SEQ ID NO: 52531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcggtaaaatgagtatgaa

SEQ ID NO: 52532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcggtaaaatgagtatgaaa

SEQ ID NO: 52533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggattttgaatatttaaat

SEQ ID NO: 52534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaatgcatataaacactc

SEQ ID NO: 52535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatcatacttgaaccaat

SEQ ID NO: 52536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attattgttattatcattat

SEQ ID NO: 52537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattgttattatcattatt

SEQ ID NO: 52538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgttattatcattattagg

SEQ ID NO: 52539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttattatcattattaggc

SEQ ID NO: 52540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttattatcattattaggca

SEQ ID NO: 52541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttattatcattattaggcag

SEQ ID NO: 52542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattatcattattaggcagg

SEQ ID NO: 52543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatcattattaggcagggg

SEQ ID NO: 52544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatgcttcaaaatgtaca

SEQ ID NO: 52545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttcaaaatgtacacagc

SEQ ID NO: 52546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatgtacacagcaagtt

SEQ ID NO: 52547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatgtacacagcaagtta

SEQ ID NO: 52548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacagcaagttaaggaaat

SEQ ID NO: 52549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcaagttaaggaaataag

SEQ ID NO: 52550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaagttaaggaaataagaa

SEQ ID NO: 52551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagttaaggaaataagaag

SEQ ID NO: 52552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaaataagaagaggtcta

SEQ ID NO: 52553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagaggtctatggactact

SEQ ID NO: 52554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaggtctatggactacttgg

SEQ ID NO: 52555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctacttggcagcactcttcc

SEQ ID NO: 52556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacttggcagcactcttccc

SEQ ID NO: 52557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcactcttcccaggatac

SEQ ID NO: 52558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactcttcccaggatacaa

SEQ ID NO: 52559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actcttcccaggatacaaga

SEQ ID NO: 52560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaggatacaagagagaaac

SEQ ID NO: 52561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggatacaagagagaaacca

SEQ ID NO: 52562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gagaaaccagagctttcaaa

SEQ ID NO: 52563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaccagagctttcaaacg

SEQ ID NO: 52564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaccagagctttcaaacgg

SEQ ID NO: 52565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accagagctttcaaacggag

SEQ ID NO: 52566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagctttcaaacggaggag

SEQ ID NO: 52567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaaacggaggagtagtgc

SEQ ID NO: 52568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaacggaggagtagtgcc

SEQ ID NO: 52569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgccaggcattctccttgta

SEQ ID NO: 52570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccaggcattctccttgtat

SEQ ID NO: 52571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggcattctccttgtatgg

SEQ ID NO: 52572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccttgtatgggagtctttt

SEQ ID NO: 52573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagtcttttcagcaattttg

SEQ ID NO: 52574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattttgcagcaatccatg

SEQ ID NO: 52575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcagcaatccatgcagca

SEQ ID NO: 52576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcatatctatgcaaatac

SEQ ID NO: 52577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcatatctatgcaaataca

SEQ ID NO: 52578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catatctatgcaaatacaag

SEQ ID NO: 52579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatgcaaatacaaggagat

SEQ ID NO: 52580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgcaaatacaaggagatg

SEQ ID NO: 52581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggagatgaggtccacatt

SEQ ID NO: 52582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatgaggtccacattgag

SEQ ID NO: 52583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggtccacattgagcagttg

SEQ ID NO: 52584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtccacattgagcagttgt

SEQ ID NO: 52585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccacattgagcagttgtgg

SEQ ID NO: 52586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaactgcaactctgtatga

SEQ ID NO: 52587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caactgcaactctgtatgaa

SEQ ID NO: 52588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactgcaactctgtatgaaa

SEQ ID NO: 52589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaagggacatgcccactta

SEQ ID NO: 52590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagggacatgcccacttac

SEQ ID NO: 52591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggacatgcccacttacag

SEQ ID NO: 52592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttacaggagtcactgcatt

SEQ ID NO: 52593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttacaggagtcactgcatta

SEQ ID NO: 52594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacaggagtcactgcattaa

SEQ ID NO: 52595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaggagtcactgcattaag

SEQ ID NO: 52596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagtcactgcattaagg

SEQ ID NO: 52597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgcattaagggggttcca

SEQ ID NO: 52598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattaagggggttccaaaga

SEQ ID NO: 52599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ccaaagaaagatgacaccct

SEQ ID NO: 52600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacaccctcggcattgatt

SEQ ID NO: 52601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaccctcggcattgattt

SEQ ID NO: 52602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaccctcggcattgattta

SEQ ID NO: 52603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcttatttttttttctcttt

SEQ ID NO: 52604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctttatattaaaattatac

SEQ ID NO: 52605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacgcccatgtgtacaaaaa

SEQ ID NO: 52606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctatacttatgctatttgt

SEQ ID NO: 52607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttttaaattttttattgt

SEQ ID NO: 52608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttattgtgagctaatta

SEQ ID NO: 52609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttattgtgagctaattat

SEQ ID NO: 52610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtgagctaattatagga

SEQ ID NO: 52611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtgagctaattataggaa

SEQ ID NO: 52612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgagctaattataggaaag

SEQ ID NO: 52613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttataggaaaggagcaaaaa

SEQ ID NO: 52614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttaacaattatataacca

SEQ ID NO: 52615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatataaccatagtaatc

SEQ ID NO: 52616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaatcaagaaaattaacac

SEQ ID NO: 52617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatcattttttattgcatt

SEQ ID NO: 52618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttagttgttatacctcat

SEQ ID NO: 52619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtctctttttatctgcaa

SEQ ID NO: 52620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctttcgtgacctgacaat

SEQ ID NO: 52621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctttcgtgacctgacaatt

SEQ ID NO: 52622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcgtgacctgacaattggg

SEQ ID NO: 52623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattgggcagaatacaaat

SEQ ID NO: 52624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatacaaatcagttattttg

SEQ ID NO: 52625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtagaatgcgtctcaact

SEQ ID NO: 52626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtagaatgcgtctcaactt

SEQ ID NO: 52627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatttttcaattcacaact

SEQ ID NO: 52628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttttcaattcacaacta

SEQ ID NO: 52629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcacaactaaggaaacta

SEQ ID NO: 52630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaactaaagcgttatcta

SEQ ID NO: 52631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaagcgttatctatggaat

SEQ ID NO: 52632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaattagatactttgctc

SEQ ID NO: 52633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaattagatactttgctca

SEQ ID NO: 52634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atactttgctcaaggtaaca

SEQ ID NO: 52635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaggtaacacagctgtgtg

SEQ ID NO: 52636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtaacacagctgtgtgtag

SEQ ID NO: 52637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacacagctgtgtgtagca

SEQ ID NO: 52638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagctgtgtgtagcagagc

SEQ ID NO: 52639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagctgtgtgtagcagagcc

SEQ ID NO: 52640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagagccaggatttgaact

SEQ ID NO: 52641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactaagatctgttactccc

SEQ ID NO: 52642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaagatctgttactcccc

SEQ ID NO: 52643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatctgttactccccaggc

SEQ ID NO: 52644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttactccccaggccagta

SEQ ID NO: 52645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaggccagtatagaaaaaa

SEQ ID NO: 52646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagaaaaaaaagataacat

SEQ ID NO: 52647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaaaaaagataacatta

SEQ ID NO: 52648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaaaaaagataacattag

SEQ ID NO: 52649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaagataacattagagg

SEQ ID NO: 52650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaagataacattagagga

SEQ ID NO: 52651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttttaaaactttaaaatg

SEQ ID NO: 52652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttaaaatgcagaaataca

SEQ ID NO: 52653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgcagaaatacatggct

SEQ ID NO: 52654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcagaaatacatggctta

SEQ ID NO: 52655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagagtatgtacctgttgca

SEQ ID NO: 52656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtatgtacctgttgcaa

SEQ ID NO: 52657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtacctgttgcaaaggtct

SEQ ID NO: 52658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttttatcgatgactcatt

SEQ ID NO: 52659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgactcatttggctttatt

SEQ ID NO: 52660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcatttggctttattcag

SEQ ID NO: 52661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggctttattcagcagactt

SEQ ID NO: 52662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattcagcagacttgagtt

SEQ ID NO: 52663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgagtttagaaattcaat

SEQ ID NO: 52664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtttagaaattcaatcagt

SEQ ID NO: 52665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagaaattcaatcagtgag

SEQ ID NO: 52666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatcagtgagtagtttatc

SEQ ID NO: 52667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taattaaataaaacaatccc

SEQ ID NO: 52668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattaaataaaacaatcccc

SEQ ID NO: 52669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaataaaacaatccccagg

SEQ ID NO: 52670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccaggaagttaattgaaaa

SEQ ID NO: 52671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgaaaaaagcctgcccat

SEQ ID NO: 52672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgaaaaaagcctgcccatc

SEQ ID NO: 52673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctgcccatcaggaacacc

SEQ ID NO: 52674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcccatcaggaacacctag

SEQ ID NO: 52675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctagaagccacgctttgt

SEQ ID NO: 52676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacgctttgttggtctgttt

SEQ ID NO: 52677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctgtttaagccaaatttc

SEQ ID NO: 52678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atttctggcacactgctctt

SEQ ID NO: 52679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaatcaaatttaaaatga

SEQ ID NO: 52680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatcaaatttaaaatgac

SEQ ID NO: 52681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaatttaaaatgacaggt

SEQ ID NO: 52682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttaaaatgacaggtaagt

SEQ ID NO: 52683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttggtcttaactttctta

SEQ ID NO: 52684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttggtcttaactttcttaa

SEQ ID NO: 52685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actttcttaaaggcacaaac

SEQ ID NO: 52686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaggcacaaacaagtaa

SEQ ID NO: 52687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgatatataatgtatca

SEQ ID NO: 52688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatataatgtatcacagaa

SEQ ID NO: 52689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatataatgtatcacagaaa

SEQ ID NO: 52690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaaggctgatttcacatg

SEQ ID NO: 52691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggctgatttcacatgtag

SEQ ID NO: 52692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtagtggccttttatcaa

SEQ ID NO: 52693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatcaacagcaacataatt

SEQ ID NO: 52694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatcaacagcaacataattt

SEQ ID NO: 52695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatttctaaatttttaatt

SEQ ID NO: 52696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaatttagatcttacttt

SEQ ID NO: 52697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactttaagatatgaaaaaa

SEQ ID NO: 52698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actttaagatatgaaaaaat

SEQ ID NO: 52699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaagatatgaaaaaatag

SEQ ID NO: 52700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaagatatgaaaaaatagg

SEQ ID NO: 52701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatatgaaaaaataggag

SEQ ID NO: 52702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatatgaaaaaataggagg

SEQ ID NO: 52703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatatgaaaaaataggagga

SEQ ID NO: 52704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgaaaaaataggaggagg

SEQ ID NO: 52705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaaaaaataggaggaggg

SEQ ID NO: 52706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaaaaaataggaggaggga

SEQ ID NO: 52707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaaaataggaggagggag

SEQ ID NO: 52708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaataggaggagggagggg

SEQ ID NO: 52709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggaggggaagctaaatgcc

SEQ ID NO: 52710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaggggaagctaaatgcct

SEQ ID NO: 52711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaggggaagctaaatgcctg

SEQ ID NO: 52712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagctaaatgcctgggga

SEQ ID NO: 52713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggaaagacatgcatgttct

SEQ ID NO: 52714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatgttcttagaattttgt

SEQ ID NO: 52715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaattttgttagaatgtaat

SEQ ID NO: 52716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaatgagtccctatgtcc

SEQ ID NO: 52717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctatgtcctagtattttta

SEQ ID NO: 52718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgttaactataatgaatt

SEQ ID NO: 52719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgttaactataatgaattt

SEQ ID NO: 52720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaactataatgaatttagg

SEQ ID NO: 52721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taactataatgaatttagga

SEQ ID NO: 52722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctataatgaatttaggaagg

SEQ ID NO: 52723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tataatgaatttaggaaggt

SEQ ID NO: 52724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgaatttaggaaggtgggt

SEQ ID NO: 52725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttaggaaggtgggtgag

SEQ ID NO: 52726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttaggaaggtgggtgaga

SEQ ID NO: 52727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaccccaataaatgatatc

SEQ ID NO: 52728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatttaaattaacaaaaac

SEQ ID NO: 52729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttaaattaacaaaaactg

SEQ ID NO: 52730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaacaaaaactggagtccc

SEQ ID NO: 52731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagtccctggcacctgaac

SEQ ID NO: 52732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaacaagtgcttgctcaaa

SEQ ID NO: 52733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgttaattacttgtaaatg

SEQ ID NO: 52734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgtaaatgtagcacttc

SEQ ID NO: 52735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgtaaatgtagcacttca

SEQ ID NO: 52736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaaatgtagcacttcaag

SEQ ID NO: 52737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaaatgtagcacttcaagg

SEQ ID NO: 52738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatgtagcacttcaaggag

SEQ ID NO: 52739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtagcacttcaaggagga

SEQ ID NO: 52740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttcaaggaggagagttaa

SEQ ID NO: 52741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaggagagttaatagtata

SEQ ID NO: 52742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggagagttaatagtataa

SEQ ID NO: 52743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tataaaggttaccttaaaat

SEQ ID NO: 52744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataacttctatgtaataata

SEQ ID NO: 52745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttctatgtaataatatgg

SEQ ID NO: 52746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatatggtggaaaataaaa

SEQ ID NO: 52747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtggaaaataaaatagat

SEQ ID NO: 52748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataaaatagatgagaacct

SEQ ID NO: 52749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagatgagaaccttagtg

SEQ ID NO: 52750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagaaccttagtgtagaata

SEQ ID NO: 52751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaatttaattctactatc

SEQ ID NO: 52752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatttaattctactatcta

SEQ ID NO: 52753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttaattctactatctaga

SEQ ID NO: 52754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaattctactatctagag

SEQ ID NO: 52755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattctactatctagagagg

SEQ ID NO: 52756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctagagaggtagcatattg

SEQ ID NO: 52757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagagaggtagcatattgt

SEQ ID NO: 52758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatattgtaggaaattat

SEQ ID NO: 52759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaattataagtccaaatgt

SEQ ID NO: 52760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccactcttgtatgaacct

SEQ ID NO: 52761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgagtaaatgatttaacct

SEQ ID NO: 52762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagtaaatgatttaacctc

SEQ ID NO: 52763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactatgtctcctatttcac

SEQ ID NO: 52764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtctcctatttcactggt

SEQ ID NO: 52765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtctcctatttcactggtg

SEQ ID NO: 52766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcctatttcactggtgagg

SEQ ID NO: 52767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcactggtgaggaagttaca

SEQ ID NO: 52768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactggtgaggaagttacac

SEQ ID NO: 52769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggtgaggaagttacacggg

SEQ ID NO: 52770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagttacacgggtagtctgt

SEQ ID NO: 52771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacacgggtagtctgttaga

SEQ ID NO: 52772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacgggtagtctgttagaaa

SEQ ID NO: 52773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acgggtagtctgttagaaag

SEQ ID NO: 52774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgggtagtctgttagaaaga

SEQ ID NO: 52775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggtagtctgttagaaagag

SEQ ID NO: 52776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgttagaaagaggggatg

SEQ ID NO: 52777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaaagaggggatgaagt

SEQ ID NO: 52778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaaagaggggatgaagta

SEQ ID NO: 52779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagaggggatgaagtaagg

SEQ ID NO: 52780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaggggatgaagtaaggc

SEQ ID NO: 52781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggatgaagtaaggcaggac

SEQ ID NO: 52782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtaaggcaggacaagcacc

SEQ ID NO: 52783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcaggacaagcacctggc

SEQ ID NO: 52784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcaggacaagcacctggct

SEQ ID NO: 52785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaggacaagcacctggcta

SEQ ID NO: 52786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctggctagggtttactcta

SEQ ID NO: 52787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggtttactctacagtatta

SEQ ID NO: 52788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtattacagcttgaaaaca

SEQ ID NO: 52789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacagcttgaaaacaaagaa

SEQ ID NO: 52790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagcttgaaaacaaagaaaa

SEQ ID NO: 52791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaagaaaagagaaaacaaa

SEQ ID NO: 52792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagaaaagagaaaacaaat

SEQ ID NO: 52793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagaaaacaaatgggaaac

SEQ ID NO: 52794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagtctccttaatgaaaat

SEQ ID NO: 52795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccttaatgaaaatgagtg

SEQ ID NO: 52796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaaaatgagtgaagacaa

SEQ ID NO: 52797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagcctcaaataacacatct

SEQ ID NO: 52798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcctcaaataacacatctt

SEQ ID NO: 52799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaaataacacatcttggg

SEQ ID NO: 52800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catcttgggaagaatgtact

SEQ ID NO: 52801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttataatttataattatct

SEQ ID NO: 52802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatatcgactatttgaca

SEQ ID NO: 52803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatatcgactatttgacat

SEQ ID NO: 52804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgacatatctattacttg

SEQ ID NO: 52805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgacatatctattacttga

SEQ ID NO: 52806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatctattacttgaaggtc

SEQ ID NO: 52807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attacttgaaggtcaagtac

SEQ ID NO: 52808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaagtgcattttaccaaa

SEQ ID NO: 52809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgcaaaactacttttcact

SEQ ID NO: 52810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caactactactactgattct

SEQ ID NO: 52811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttgaattttttaaaaat

SEQ ID NO: 52812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttgaattttttaaaaatc

SEQ ID NO: 52813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatcaggcttctaatcgtt

SEQ ID NO: 52814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcttctaatcgttaagact

SEQ ID NO: 52815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctcttctttcttttttga

SEQ ID NO: 52816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtgtatttctgtgtcacc

SEQ ID NO: 52817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgtatttctgtgtcaccc

SEQ ID NO: 52818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctgtgtcacccaggctg

SEQ ID NO: 52819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgtcacccaggctgtagtg

SEQ ID NO: 52820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacccaggctgtagtgcag

SEQ ID NO: 52821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtagtgcagtagtgcattga

SEQ ID NO: 52822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgcattgacagctcactg

SEQ ID NO: 52823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcactgcagcctccacctc

SEQ ID NO: 52824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcactgcagcctccacctct

SEQ ID NO: 52825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcctccacctctgggattc

SEQ ID NO: 52826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagtgaccctcccacct

SEQ ID NO: 52827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctcccacctcagcctctc

SEQ ID NO: 52828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccacctcagcctctcaag

SEQ ID NO: 52829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctcagcctctcaagtagc

SEQ ID NO: 52830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctcagcctctcaagtagct

SEQ ID NO: 52831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctcaagtagctaggactg

SEQ ID NO: 52832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcaagtagctaggactgc

SEQ ID NO: 52833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagtagctaggactgcagg

SEQ ID NO: 52834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtagctaggactgcaggc

SEQ ID NO: 52835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcaggcgccacaacacc

SEQ ID NO: 52836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcgccacaacacccggct

SEQ ID NO: 52837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagttttgtctatttttta

SEQ ID NO: 52838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtctattttttatagaaa

SEQ ID NO: 52839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtctattttttatagaaat

SEQ ID NO: 52840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtctattttttatagaaatg

SEQ ID NO: 52841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggggtcttactatgttgccc

SEQ ID NO: 52842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttactatgttgccccggc

SEQ ID NO: 52843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccggctggtcttgaactcc

SEQ ID NO: 52844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccggctggtcttgaactcct

SEQ ID NO: 52845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcttgaactcctgggctc

SEQ ID NO: 52846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaagtgatccacccacct

SEQ ID NO: 52847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacccacctcagcctccca

SEQ ID NO: 52848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctcagcctcccaaagtgc

SEQ ID NO: 52849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcccaaagtgct

SEQ ID NO: 52850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgctgggattg

SEQ ID NO: 52851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgctgggattgc

SEQ ID NO: 52852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgggattgcaggcat

SEQ ID NO: 52853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggcatgagccgtcctgcc

SEQ ID NO: 52854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccgtcctgcctggctttg

SEQ ID NO: 52855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcatgtacaaatatatgcc

SEQ ID NO: 52856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaatatatgccaagaata

SEQ ID NO: 52857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatatgccaagaatatgg

SEQ ID NO: 52858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgtgcattgatatacta

SEQ ID NO: 52859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatactaaagtattttcta

SEQ ID NO: 52860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctaaagaactatttcctt

SEQ ID NO: 52861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttaattgaccttacctttt

SEQ ID NO: 52862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgaccttacctttttag

SEQ ID NO: 52863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accttacctttttagaagaa

SEQ ID NO: 52864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagaagaaaagttgaaaac

SEQ ID NO: 52865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagaagaaaagttgaaaact

SEQ ID NO: 52866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaaagttgaaaactgggc

SEQ ID NO: 52867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaagttgaaaactgggct

SEQ ID NO: 52868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaagttgaaaactgggctg

SEQ ID NO: 52869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactgggctggggaacaaa

SEQ ID NO: 52870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggggaacaaatggaaaat

SEQ ID NO: 52871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaactatcatgtatgtaa

SEQ ID NO: 52872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taactatcatgtatgtaata

SEQ ID NO: 52873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatagagtgacatttgtc

SEQ ID NO: 52874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgacatttgtcaagcaaa

SEQ ID NO: 52875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaatggaaatttcacattc

SEQ ID NO: 52876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcacattcaagaataact

SEQ ID NO: 52877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacatatctatataatgaca

SEQ ID NO: 52878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatctatataatgacatggt

SEQ ID NO: 52879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgacatggtgagttacac

SEQ ID NO: 52880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acactggtttataattttca

SEQ ID NO: 52881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcacagctctttcacata

SEQ ID NO: 52882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctctaaaatataaactgca

SEQ ID NO: 52883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctttcatttttcttacca

SEQ ID NO: 52884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctttcatttttcttaccaa

SEQ ID NO: 52885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttaccaaaggtgacatt

SEQ ID NO: 52886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtgacattgagatttaca

SEQ ID NO: 52887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acattgagatttacaaagtt

SEQ ID NO: 52888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtttggtgcttgttacc

SEQ ID NO: 52889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgttaccaagtcatgttt

SEQ ID NO: 52890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgttaccaagtcatgttta

SEQ ID NO: 52891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgtttaaggaaacattg

SEQ ID NO: 52892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaacattgaagctatgac

SEQ ID NO: 52893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacattgaagctatgaccag

SEQ ID NO: 52894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaagctatgaccagaagt

SEQ ID NO: 52895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaagctatgaccagaagtc

SEQ ID NO: 52896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgaccagaagtcaggcttt

SEQ ID NO: 52897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagtcaggctttgagcttt

SEQ ID NO: 52898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggctttgagctttgagtt

SEQ ID NO: 52899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctttgagctttgagttcag

SEQ ID NO: 52900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcccactttataccgtct

SEQ ID NO: 52901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactttataccgtctaagaa

SEQ ID NO: 52902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaagaaaagttaatttga

SEQ ID NO: 52903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaagttaatttgatag

SEQ ID NO: 52904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttgatagaagacaatga

SEQ ID NO: 52905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagaagacaatgaaagaat

SEQ ID NO: 52906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgaaagaattggcaacaa

SEQ ID NO: 52907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattggcaacaatagacctg

SEQ ID NO: 52908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagacctgcagatgttttaa

SEQ ID NO: 52909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agacctgcagatgttttaaa

SEQ ID NO: 52910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagatgttttaaaaggcac

SEQ ID NO: 52911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttttaaaaggcactagtt

SEQ ID NO: 52912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatgcctaaatatgtaca

SEQ ID NO: 52913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatgcctaaatatgtacat

SEQ ID NO: 52914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgtacatgggtctcttt

SEQ ID NO: 52915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtctctttaagactccaca

SEQ ID NO: 52916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctctttaagactccacaaa

SEQ ID NO: 52917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccacaaagagacactgct

SEQ ID NO: 52918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccacaaagagacactgctaa

SEQ ID NO: 52919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacactgctaagagttac

SEQ ID NO: 52920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagttactggaaacaaacta

SEQ ID NO: 52921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgctctgtgaataaattct

SEQ ID NO: 52922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgaataaattcttagttca

SEQ ID NO: 52923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcttagttcacagttgctg

SEQ ID NO: 52924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcttagttcacagttgctgt

SEQ ID NO: 52925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgctgtgggaaaaaatga

SEQ ID NO: 52926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgaaagatccaattaca

SEQ ID NO: 52927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagatccaattacaaagtc

SEQ ID NO: 52928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagatccaattacaaagtct

SEQ ID NO: 52929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatccaattacaaagtctgg

SEQ ID NO: 52930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgggagatttcctataat

SEQ ID NO: 52931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atattacttttgctatgaca

SEQ ID NO: 52932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttttgctatgacacagta

SEQ ID NO: 52933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgctatgacacagtacag

SEQ ID NO: 52934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatgacacagtacagaaga

SEQ ID NO: 52935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgacacagtacagaagaa

SEQ ID NO: 52936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagtacagaagaaaggaaa

SEQ ID NO: 52937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtacagaagaaaggaaaa

SEQ ID NO: 52938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacagaagaaaggaaaaagg

SEQ ID NO: 52939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagaagaaaggaaaaaggaa

SEQ ID NO: 52940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaagaaaggaaaaaggaag

SEQ ID NO: 52941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttaattgcttttttactaa

SEQ ID NO: 52942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactaacagcctgtgtctc

SEQ ID NO: 52943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tactaacagcctgtgtctca

SEQ ID NO: 52944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacagcctgtgtctcaagg

SEQ ID NO: 52945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcctgtgtctcaaggaagcc

SEQ ID NO: 52946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cattaatctgtcatttcatt

SEQ ID NO: 52947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attaatctgtcatttcattc

SEQ ID NO: 52948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatttcattcaggaaatac

SEQ ID NO: 52949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcattcaggaaatacaaga

SEQ ID NO: 52950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcattcaggaaatacaagaa

SEQ ID NO: 52951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aggaaatacaagaaaggttt

SEQ ID NO: 52952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggtttcggttttaacctt

SEQ ID NO: 52953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttttaaccttaagaatac

SEQ ID NO: 52954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttttaaccttaagaatact

SEQ ID NO: 52955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctcttatattgttttgt

SEQ ID NO: 52956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgttttgtaagcatacttg

SEQ ID NO: 52957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcagaataatgtcaataca

SEQ ID NO: 52958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagaataatgtcaatacat

SEQ ID NO: 52959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagaataatgtcaatacata

SEQ ID NO: 52960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaataatgtcaatacatagg

SEQ ID NO: 52961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataatgtcaatacataggg

SEQ ID NO: 52962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataatgtcaatacataggga

SEQ ID NO: 52963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaatacatagggagggttg

SEQ ID NO: 52964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacttgtgtttctgcatgtg

SEQ ID NO: 52965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtatactatgttgttccc

SEQ ID NO: 52966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatattataccttatattt

SEQ ID NO: 52967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattatgatgccctataaa

SEQ ID NO: 52968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attatgatgccctataaata

SEQ ID NO: 52969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgccctataaatagagaa

SEQ ID NO: 52970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaagcgcacaaacacat

SEQ ID NO: 52971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacacatcagcacgtatgta

SEQ ID NO: 52972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatttactttaaaatcgtt

SEQ ID NO: 52973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaaatcgtttagaatctt

SEQ ID NO: 52974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaatcgtttagaatcttt

SEQ ID NO: 52975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaatctttgggctattta

SEQ ID NO: 52976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacacaaatgacttcaat

SEQ ID NO: 52977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaatgacttcaatcagtaa

SEQ ID NO: 52978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatcagtaatagaaccaatc

SEQ ID NO: 52979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctagtcaatgaatgccata

SEQ ID NO: 52980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtcaatgaatgccatatg

SEQ ID NO: 52981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catatggagatgtccctgtt

SEQ ID NO: 52982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggtcactttttgacactg

SEQ ID NO: 52983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtcactttttgacactgc

SEQ ID NO: 52984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactttttgacactgcaggc

SEQ ID NO: 52985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaccccttcaatgtgccaa

SEQ ID NO: 52986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgccaatggtcaactactg

SEQ ID NO: 52987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatggtcaactactgcagt

SEQ ID NO: 52988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagctttcctgcctttcctt

SEQ ID NO: 52989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agctttcctgcctttcctta

SEQ ID NO: 52990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccttaaggtgataatatcta

SEQ ID NO: 52991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttaaggtgataatatctat

SEQ ID NO: 52992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgataatatctataggacc

SEQ ID NO: 52993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttttccatccttataatt

SEQ ID NO: 52994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaagtgttacaaacatta

SEQ ID NO: 52995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacattatggctttaatta

SEQ ID NO: 52996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatggctttaattatagtg

SEQ ID NO: 52997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggcttaaactgtttttta

SEQ ID NO: 52998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttaaagattaaaccat

SEQ ID NO: 52999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttaaagattaaaccatta

SEQ ID NO: 53000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagattaaaccattagagt

SEQ ID NO: 53001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agattaaaccattagagtca

SEQ ID NO: 53002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaattttctacctcacgtt

SEQ ID NO: 53003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctacctcacgtttagaa

SEQ ID NO: 53004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctacctcacgtttagaata

SEQ ID NO: 53005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttgatcatcacccttac

SEQ ID NO: 53006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacccttaccagctcaataa

SEQ ID NO: 53007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaataccaataataataa

SEQ ID NO: 53008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttataaacaatctacacatg

SEQ ID NO: 53009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataaaattgaaactttta

SEQ ID NO: 53010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattgaaacttttaaagat

SEQ ID NO: 53011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacttttaaagataagaatg

SEQ ID NO: 53012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagataagaatgaagaca

SEQ ID NO: 53013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatgaagacaaagctcttc

SEQ ID NO: 53014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctcttccagcattgttct

SEQ ID NO: 53015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctcttccagcattgttctt

SEQ ID NO: 53016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taggtgtgcatattcaactt

SEQ ID NO: 53017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atattcaactttggaaacca

SEQ ID NO: 53018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgcatacatccaccacca

SEQ ID NO: 53019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atccaccaccaaagcttccc

SEQ ID NO: 53020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaccaccaaagcttccctg

SEQ ID NO: 53021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaagcttccctggagaact

SEQ ID NO: 53022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagcttccctggagaactc

SEQ ID NO: 53023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatgctgcaaaaacgtttt

SEQ ID NO: 53024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaaaacgtttttagcaca

SEQ ID NO: 53025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaacgtttttagcacata

SEQ ID NO: 53026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagcacatagagtgcatt

SEQ ID NO: 53027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgcattgagttttaaaac

SEQ ID NO: 53028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactagcattctttcaacat

SEQ ID NO: 53029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctcttgcataacatctttc

SEQ ID NO: 53030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttgcataacatctttcta

SEQ ID NO: 53031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaaaattaactaaataatg

SEQ ID NO: 53032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaactaaataatgtagtg

SEQ ID NO: 53033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaactaaataatgtagtgc

SEQ ID NO: 53034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataatgtagtgcaggtaaa

SEQ ID NO: 53035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataattacactaattttct

SEQ ID NO: 53036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attacactaattttcttggt

SEQ ID NO: 53037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttacactaattttcttggtg

SEQ ID NO: 53038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttcttggtgaggtgaaaa

SEQ ID NO: 53039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttggtgaggtgaaaaaa

SEQ ID NO: 53040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catatactttgcttgtttta

SEQ ID NO: 53041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatactttgcttgttttat

SEQ ID NO: 53042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttataggaaaaaaatta

SEQ ID NO: 53043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagatttgtgataacctatt

SEQ ID NO: 53044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcaatgttttatttcaaa

SEQ ID NO: 53045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttatttcaaaaagaaaa

SEQ ID NO: 53046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttcaaaaagaaaacag

SEQ ID NO: 53047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaaagaaaacagaagta

SEQ ID NO: 53048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaagaaaacagaagtaa

SEQ ID NO: 53049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttcacatataaaaaccca

SEQ ID NO: 53050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atataaaaacccaaagcttt

SEQ ID NO: 53051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataaaaacccaaagctttt

SEQ ID NO: 53052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaacccaaagcttttag

SEQ ID NO: 53053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacatatgttgatatttta

SEQ ID NO: 53054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttgatattttatagaac

SEQ ID NO: 53055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttgatattttatagaact

SEQ ID NO: 53056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgcttgtattttcaaaa

SEQ ID NO: 53057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttgtattttcaaaatag

SEQ ID NO: 53058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgattgatacaaaatac

SEQ ID NO: 53059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatactagattacttttc

SEQ ID NO: 53060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatactagattacttttct

SEQ ID NO: 53061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagattacttttctgggaaa

SEQ ID NO: 53062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaatatttattttatttc

SEQ ID NO: 53063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatatttattttatttcaa

SEQ ID NO: 53064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgattctatacatcatctca

SEQ ID NO: 53065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatacatcatctcaaagtc

SEQ ID NO: 53066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatcatctcaaagtcaagc

SEQ ID NO: 53067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcatctcaaagtcaagcaa

SEQ ID NO: 53068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatctcaaagtcaagcaag

SEQ ID NO: 53069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catctcaaagtcaagcaaga

SEQ ID NO: 53070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcaagcaagagggaacctt

SEQ ID NO: 53071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagagggaacctttggttt

SEQ ID NO: 53072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagagggaacctttggtttg

SEQ ID NO: 53073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacctttggtttgaggacta

SEQ ID NO: 53074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctttggtttgaggactat

SEQ ID NO: 53075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggtttgaggactatagga

SEQ ID NO: 53076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggactataggatggtatt

SEQ ID NO: 53077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggatggtattaagaactat

SEQ ID NO: 53078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtattaagaactatgaga

SEQ ID NO: 53079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagaacctgatttgaattg

SEQ ID NO: 53080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtctttacttctctaaacca

SEQ ID NO: 53081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacggtttcctcattgaaa

SEQ ID NO: 53082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cggtttcctcattgaaaaag

SEQ ID NO: 53083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcctcattgaaaaagtgg

SEQ ID NO: 53084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcctcattgaaaaagtgga

SEQ ID NO: 53085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcattgaaaaagtggaaggc

SEQ ID NO: 53086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattgaaaaagtggaaggcc

SEQ ID NO: 53087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtggaaggccaggtgtga

SEQ ID NO: 53088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggctcatgcctataatcc

SEQ ID NO: 53089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctataatcccagcactt

SEQ ID NO: 53090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctataatcccagcacttt

SEQ ID NO: 53091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctataatcccagcactttgg

SEQ ID NO: 53092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataatcccagcactttggg

SEQ ID NO: 53093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcactttgggaggcc

SEQ ID NO: 53094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttgggaggccg

SEQ ID NO: 53095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccagcactttgggaggccga

SEQ ID NO: 53096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagcactttgggaggccgag

SEQ ID NO: 53097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactttgggaggccgaggg

SEQ ID NO: 53098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttgggaggccgaggggag

SEQ ID NO: 53099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggccgaggggagtggatct

SEQ ID NO: 53100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagtggatctcagctactc

SEQ ID NO: 53101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtggatctcagctactcaa

SEQ ID NO: 53102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtggatctcagctactcaag

SEQ ID NO: 53103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcagctactcaagaggct

SEQ ID NO: 53104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctactcaagaggctgaga

SEQ ID NO: 53105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctactcaagaggctgagac

SEQ ID NO: 53106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgagacaggatgtttgctt

SEQ ID NO: 53107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggatgtttgcttgagcccc

SEQ ID NO: 53108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggatgtttgcttgagcccct

SEQ ID NO: 53109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatgtttgcttgagcccctg

SEQ ID NO: 53110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgcttgagcccctgggga

SEQ ID NO: 53111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcttgagcccctggggatg

SEQ ID NO: 53112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcttgagcccctggggatgg

SEQ ID NO: 53113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcccctggggatggaggttg

SEQ ID NO: 53114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgactgtgccactgcact

SEQ ID NO: 53115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtgccactgcactcagcc

SEQ ID NO: 53116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtgccactgcactcagcct

SEQ ID NO: 53117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgccactgcactcagcctgg

SEQ ID NO: 53118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgcactcagcctgggaga

SEQ ID NO: 53119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcactcagcctgggagaca

SEQ ID NO: 53120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcagcctgggagacagagt

SEQ ID NO: 53121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgagattgtgtttcaaaaa

SEQ ID NO: 53122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtgtttcaaaaaaagaa

SEQ ID NO: 53123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttcaaaaaaagaaaagaa

SEQ ID NO: 53124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaagaaaagaaaagaa

SEQ ID NO: 53125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaagaaaagaaaagaa

SEQ ID NO: 53126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaagaaaagaaaagaaa

SEQ ID NO: 53127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagaaaagaaaagaaaaag

SEQ ID NO: 53128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaagaaaagaaaaagtg

SEQ ID NO: 53129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaaagaaaaagtggaga

SEQ ID NO: 53130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattattgtgtgcattacaa

SEQ ID NO: 53131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgtacaaatcattttatg

SEQ ID NO: 53132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtagatgctttataatgta

SEQ ID NO: 53133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgctttataatgtaaagt

SEQ ID NO: 53134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctttataatgtaaagtgag

SEQ ID NO: 53135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttataatgtaaagtgagta

SEQ ID NO: 53136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttataatgtaaagtgagtag

SEQ ID NO: 53137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tataatgtaaagtgagtaga

SEQ ID NO: 53138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataatgtaaagtgagtagag

SEQ ID NO: 53139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaagtgagtagaggggca

SEQ ID NO: 53140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagtagaggggcaaagcac

SEQ ID NO: 53141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattaaatctcaaaatgct

SEQ ID NO: 53142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgtcaattctttacttgt

SEQ ID NO: 53143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attctttacttgtgagataa

SEQ ID NO: 53144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacttgtgagataacagat

SEQ ID NO: 53145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacttgtgagataacagatt

SEQ ID NO: 53146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagataacagattaggatca

SEQ ID NO: 53147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataacagattaggatcatg

SEQ ID NO: 53148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcatggagaattatctaa

SEQ ID NO: 53149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagtacatatgcctttcta

SEQ ID NO: 53150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtacatatgcctttctatg

SEQ ID NO: 53151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctttctatggagaaatgct

SEQ ID NO: 53152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaatgctaagtcttttta

SEQ ID NO: 53153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatgctaagtctttttac

SEQ ID NO: 53154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggaatccaaactttgctt

SEQ ID NO: 53155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccaaactttgctttagtta

SEQ ID NO: 53156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccaatcaactaaactaaac

SEQ ID NO: 53157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaactaaactaaactagca

SEQ ID NO: 53158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaaactagcacagacaaa

SEQ ID NO: 53159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actagcacagacaaaaagaa

SEQ ID NO: 53160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgatcacatcacattact

SEQ ID NO: 53161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacattacttagaataaatg

SEQ ID NO: 53162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttagaataaatgaagtat

SEQ ID NO: 53163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttagaataaatgaagtata

SEQ ID NO: 53164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatgaagtataaggttaa

SEQ ID NO: 53165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgacattaataatactaaa

SEQ ID NO: 53166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatactaaaaagccttata

SEQ ID NO: 53167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatatgacattaataat

SEQ ID NO: 53168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatatgacattaataata

SEQ ID NO: 53169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatctattatttcatttg

SEQ ID NO: 53170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttcatttgaagctgataa

SEQ ID NO: 53171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgataatagcactactaaaa

SEQ ID NO: 53172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agataccattaactatcacc

SEQ ID NO: 53173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gataccattaactatcacct

SEQ ID NO: 53174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccattaactatcacctgg

SEQ ID NO: 53175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaacatgaatatgaaatat

SEQ ID NO: 53176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaaatatgagaaaccaca

SEQ ID NO: 53177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgagaaaccacaaagaa

SEQ ID NO: 53178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaaagcctttgatgaaa

SEQ ID NO: 53179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacagcatcttacgaaact

SEQ ID NO: 53180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacagcatcttacgaaacta

SEQ ID NO: 53181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtaatttgtacattcgct

SEQ ID NO: 53182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtacattcgcttagaaaa

SEQ ID NO: 53183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgcttagaaaatagtccttc

SEQ ID NO: 53184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttcaagtcatccgccat

SEQ ID NO: 53185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaattgtttaaccttgc

SEQ ID NO: 53186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaattgtttaaccttgcaa

SEQ ID NO: 53187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttaaccttgcaagagtac

SEQ ID NO: 53188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttaaccttgcaagagtact

SEQ ID NO: 53189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttgcaagagtactgggct

SEQ ID NO: 53190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagtactgggcttggtcaa

SEQ ID NO: 53191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggcttggtcaaaagaaact

SEQ ID NO: 53192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctataaatcatcattatac

SEQ ID NO: 53193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcattatactagcaattcat

SEQ ID NO: 53194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctagcaattcatcagcatgt

SEQ ID NO: 53195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatgttagatcttgtgtaa

SEQ ID NO: 53196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgttagatcttgtgtaaa

SEQ ID NO: 53197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataatctaatttgttttg

SEQ ID NO: 53198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgttttgaagctccttt

SEQ ID NO: 53199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccttttcatgtctcttttc

SEQ ID NO: 53200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcatgtctcttttctgga

SEQ ID NO: 53201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctacaatcctttgtgcaaa

SEQ ID NO: 53202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctacaatcctttgtgcaaac

SEQ ID NO: 53203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacaatcctttgtgcaaaca

SEQ ID NO: 53204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcctttgtgcaaacaggga

SEQ ID NO: 53205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagggaaagaaaaaacaatc

SEQ ID NO: 53206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaatcaagataccaaact

SEQ ID NO: 53207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatcaagataccaaactaa

SEQ ID NO: 53208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcaagataccaaactaag

SEQ ID NO: 53209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagataccaaactaagagg

SEQ ID NO: 53210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttccatcactgacatca

SEQ ID NO: 53211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacatcatagctgtatgat

SEQ ID NO: 53212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatagctgtatgattagat

SEQ ID NO: 53213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgagaaaacccaaaatatg

SEQ ID NO: 53214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagaaaacccaaaatatgt

SEQ ID NO: 53215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaacccaaaatatgtgg

SEQ ID NO: 53216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaacccaaaatatgtggg

SEQ ID NO: 53217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaacccaaaatatgtgggag

SEQ ID NO: 53218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccaaaatatgtgggaggag

SEQ ID NO: 53219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaaaatatgtgggaggaga

SEQ ID NO: 53220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcctctgcccctgatgtg

SEQ ID NO: 53221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctctgcccctgatgtgaag

SEQ ID NO: 53222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcccctgatgtgaagcag

SEQ ID NO: 53223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgatgtgaagcagcagtgt

SEQ ID NO: 53224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgaagcagcagtgtaaga

SEQ ID NO: 53225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcagcagtgtaagacaga

SEQ ID NO: 53226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtcctttgttatctttgc

SEQ ID NO: 53227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctttgttatctttgccag

SEQ ID NO: 53228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgccagaagctttttctc

SEQ ID NO: 53229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgccagaagctttttctcg

SEQ ID NO: 53230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttttctcgaggaactaaa

SEQ ID NO: 53231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctcgaggaactaaatgg

SEQ ID NO: 53232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaagctttgactacattt

SEQ ID NO: 53233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacatttcagacctcatga

SEQ ID NO: 53234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctcatgaaagaaataaat

SEQ ID NO: 53235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaagaaataaattagattt

SEQ ID NO: 53236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaatataccccaattactc

SEQ ID NO: 53237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaatataccccaattactcc

SEQ ID NO: 53238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atataccccaattactccag

SEQ ID NO: 53239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccaggagttaaaatatta

SEQ ID NO: 53240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatattacagcctgtgtat

SEQ ID NO: 53241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attacagcctgtgtataaga

SEQ ID NO: 53242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttacagcctgtgtataagat

SEQ ID NO: 53243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtgtataagatgggtatc

SEQ ID NO: 53244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtataagatgggtatctag

SEQ ID NO: 53245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgggtatctagtggctt

SEQ ID NO: 53246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgggtatctagtggcttcag

SEQ ID NO: 53247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtatctagtggcttcagta

SEQ ID NO: 53248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctttaactatcatccatg

SEQ ID NO: 53249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaactatcatccatgtgg

SEQ ID NO: 53250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaactatcatccatgtgga

SEQ ID NO: 53251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taactatcatccatgtggaa

SEQ ID NO: 53252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctatcatccatgtggaaggg

SEQ ID NO: 53253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgaatcaatcaatgaatc

SEQ ID NO: 53254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatatatatcttgattatg

SEQ ID NO: 53255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggtactcaatgttctttca

SEQ ID NO: 53256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcacagaatctctatttt

SEQ ID NO: 53257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcacagaatctctattttt

SEQ ID NO: 53258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctatttttaggatttctt

SEQ ID NO: 53259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctatttttaggatttcttc

SEQ ID NO: 53260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaggacatcatgacaaaat

SEQ ID NO: 53261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattagtactgaattg

SEQ ID NO: 53262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaattgtggtgtgcataact

SEQ ID NO: 53263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttagaaaaaaatatgcata

SEQ ID NO: 53264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaaaaatatgcataaag

SEQ ID NO: 53265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaattttttctataacaat

SEQ ID NO: 53266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attatcctcattttaattca

SEQ ID NO: 53267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcctcattttaattcatg

SEQ ID NO: 53268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctcattttaattcatgga

SEQ ID NO: 53269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttaattcatggagagtta

SEQ ID NO: 53270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagttacagatgttcattt

SEQ ID NO: 53271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacagatgttcatttgaga

SEQ ID NO: 53272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgttcatttgagatagat

SEQ ID NO: 53273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgttcatttgagatagatc

SEQ ID NO: 53274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcatttgagatagatcag

SEQ ID NO: 53275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catttgagatagatcaggag

SEQ ID NO: 53276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttgagatagatcaggagt

SEQ ID NO: 53277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagatagatcaggagtggg

SEQ ID NO: 53278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatagatcaggagtgggca

SEQ ID NO: 53279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatagatcaggagtgggcag

SEQ ID NO: 53280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatcaggagtgggcagagg

SEQ ID NO: 53281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatcaggagtgggcagaggc

SEQ ID NO: 53282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtgggcagaggcaggtttt

SEQ ID NO: 53283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgaaaactttcaccacgtt

SEQ ID NO: 53284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaaactttcaccacgttg

SEQ ID NO: 53285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactttcaccacgttgaggt

SEQ ID NO: 53286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcagtatgctcttgaaaaa

SEQ ID NO: 53287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaaaaagtaacaaaaaa

SEQ ID NO: 53288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaagtaacaaaaaaaag

SEQ ID NO: 53289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaagtaacaaaaaaaagt

SEQ ID NO: 53290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaagtaacaaaaaaaagta

SEQ ID NO: 53291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacaaaaaaaagtagggaa

SEQ ID NO: 53292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacaaaaaaaagtagggaaa

SEQ ID NO: 53293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaaaaaaagtagggaaaa

SEQ ID NO: 53294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaaaaaagtagggaaaag

SEQ ID NO: 53295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattgattgatataaaact

SEQ ID NO: 53296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgatataaaactaagttc

SEQ ID NO: 53297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagttccagaaaaacaatc

SEQ ID NO: 53298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagttccagaaaaacaatct

SEQ ID NO: 53299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctaggcatttcaaattaa

SEQ ID NO: 53300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaggcatttcaaattaata

SEQ ID NO: 53301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggcatttcaaattaatag

SEQ ID NO: 53302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaaacatacaaacaaaaa

SEQ ID NO: 53303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaaaacagatataattgc

SEQ ID NO: 53304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgccagaaaatcctgttg

SEQ ID NO: 53305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaatcctgttgaagatg

SEQ ID NO: 53306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaatcctgttgaagatga

SEQ ID NO: 53307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattgctttccttcttcct

SEQ ID NO: 53308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctgagctcctgatgttgt

SEQ ID NO: 53309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttgtaagttgtcatcat

SEQ ID NO: 53310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttgtcatcattagtaatg

SEQ ID NO: 53311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcatcattagtaatgaaga

SEQ ID NO: 53312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtaatgaagatggtatcgc

SEQ ID NO: 53313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcctccccaaataaaataaa

SEQ ID NO: 53314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctccccaaataaaataaac

SEQ ID NO: 53315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctccccaaataaaataaacg

SEQ ID NO: 53316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctttttattttcatccc

SEQ ID NO: 53317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctttttattttcatcccaa

SEQ ID NO: 53318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagagaatatcttctaacga

SEQ ID NO: 53319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatatcttctaacgatag

SEQ ID NO: 53320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acgatagaagtttatcatgt

SEQ ID NO: 53321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgatagaagtttatcatgtt

SEQ ID NO: 53322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaagtttatcatgttagg

SEQ ID NO: 53323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtttatcatgttaggaaga

SEQ ID NO: 53324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaagcaactgtttaaaca

SEQ ID NO: 53325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaagcaactgtttaaacat

SEQ ID NO: 53326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactgaaaaacaactgaatc

SEQ ID NO: 53327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctagcttcctccctgaatt

SEQ ID NO: 53328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctagcttcctccctgaattt

SEQ ID NO: 53329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcttcctccctgaatttgg

SEQ ID NO: 53330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggagtattctgcactaaaa

SEQ ID NO: 53331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatctgccttgaaacaaca

SEQ ID NO: 53332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgccttgaaacaacaaaga

SEQ ID NO: 53333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccttgaaacaacaaagatg

SEQ ID NO: 53334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaaacaacaaagatggag

SEQ ID NO: 53335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taccttactgaaatatgaat

SEQ ID NO: 53336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accttactgaaatatgaata

SEQ ID NO: 53337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctcattctcctgctcctc

SEQ ID NO: 53338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcattctcctgctcctct

SEQ ID NO: 53339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctgctcctctgggctttt

SEQ ID NO: 53340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgagtaacctgtgctgctg

SEQ ID NO: 53341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagtaacctgtgctgctgt

SEQ ID NO: 53342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtaacctgtgctgctgtgg

SEQ ID NO: 53343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaacctgtgctgctgtggg

SEQ ID NO: 53344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtattaccacttcgtgaa

SEQ ID NO: 53345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtattaccacttcgtgaaaa

SEQ ID NO: 53346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttcgtgaaaagagtaaac

SEQ ID NO: 53347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtgaaaagagtaaacaagc

SEQ ID NO: 53348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtaaacaagcaagaaaac

SEQ ID NO: 53349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaaacaagcaagaaaacaa

SEQ ID NO: 53350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaagcaagaaaacaagagt

SEQ ID NO: 53351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccttaatcaatttctcaaa

SEQ ID NO: 53352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaatttctcaaaaagacca

SEQ ID NO: 53353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatttctcaaaaagaccat

SEQ ID NO: 53354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cataggccataaaaattgaa

SEQ ID NO: 53355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgaatagatcatcacaa

SEQ ID NO: 53356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaaagtcttctcattatt

SEQ ID NO: 53357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaagtcttctcattattt

SEQ ID NO: 53358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taactaaattccaaatgcaa

SEQ ID NO: 53359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattccaaatgcaatagca

SEQ ID NO: 53360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgcaatagcaaagatca

SEQ ID NO: 53361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacttttcttctccctcat

SEQ ID NO: 53362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagtgaacctgttgtaact

SEQ ID NO: 53363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcatttctcatacttgtct

SEQ ID NO: 53364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcatacttgtcttggaa

SEQ ID NO: 53365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaataccttttatttatct

SEQ ID NO: 53366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accttttatttatctcagca

SEQ ID NO: 53367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttatttatctcagcaaagt

SEQ ID NO: 53368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaacaactcaatactgtc

SEQ ID NO: 53369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaactcaatactgtccag

SEQ ID NO: 53370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatgtattaaacttctta

SEQ ID NO: 53371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttaaagtacataatactt

SEQ ID NO: 53372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acataatacttgagccgtca

SEQ ID NO: 53373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgagccgtcaaagacaca

SEQ ID NO: 53374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agccgtcaaagacacacaga

SEQ ID NO: 53375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccgtcaaagacacacagat

SEQ ID NO: 53376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagacacacagatgggcctc

SEQ ID NO: 53377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agacacacagatgggcctct

SEQ ID NO: 53378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacacacagatgggcctcta

SEQ ID NO: 53379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acacacagatgggcctctag

SEQ ID NO: 53380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatttctcctaataaatgt

SEQ ID NO: 53381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgtgagatgctctgctc

SEQ ID NO: 53382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgagatgctctgctcaagc

SEQ ID NO: 53383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagatgctctgctcaagct

SEQ ID NO: 53384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgtatctcctgtttgtga

SEQ ID NO: 53385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcctgtttgtgaaagata

SEQ ID NO: 53386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtttgtgaaagatatggtt

SEQ ID NO: 53387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctaccctgacaacaaaacc

SEQ ID NO: 53388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaacaaaaccaagcacat

SEQ ID NO: 53389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaagcacattagtgacct

SEQ ID NO: 53390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaagcacattagtgaccta

SEQ ID NO: 53391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caagcacattagtgacctaa

SEQ ID NO: 53392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attagtgacctaagggactg

SEQ ID NO: 53393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtgacctaagggactgca

SEQ ID NO: 53394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgctattgtttgacaccaa

SEQ ID NO: 53395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgctattgtttgacaccaaa

SEQ ID NO: 53396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtttgacaccaaaaggaat

SEQ ID NO: 53397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattggaaacttactaaata

SEQ ID NO: 53398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggaaacttactaaatatg

SEQ ID NO: 53399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaacttactaaatatggag

SEQ ID NO: 53400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacttactaaatatggagc

SEQ ID NO: 53401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactaaatatggagcaggtg

SEQ ID NO: 53402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaaatatggagcaggtgca

SEQ ID NO: 53403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctatcattgttctctcta

SEQ ID NO: 53404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcattgttctctctaaagcg

SEQ ID NO: 53405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cattgttctctctaaagcgt

SEQ ID NO: 53406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctctctaaagcgtgggtt

SEQ ID NO: 53407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctctaaagcgtgggttc

SEQ ID NO: 53408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctaaagcgtgggttcagg

SEQ ID NO: 53409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctaaagcgtgggttcaggt

SEQ ID NO: 53410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtgggttcaggtgggaatc

SEQ ID NO: 53411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggaatcaagctcattgaa

SEQ ID NO: 53412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaagtatatgatatataa

SEQ ID NO: 53413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatataaaagtacataata

SEQ ID NO: 53414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaagtatgtaatttgtga

SEQ ID NO: 53415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtatgtaatttgtgatag

SEQ ID NO: 53416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtatgtaatttgtgatagt

SEQ ID NO: 53417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttgtgatagtaggtgaa

SEQ ID NO: 53418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgatagtaggtgaaaagc

SEQ ID NO: 53419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgatagtaggtgaaaagcc

SEQ ID NO: 53420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatagtaggtgaaaagccag

SEQ ID NO: 53421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtaggtgaaaagccagga

SEQ ID NO: 53422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtaggtgaaaagccaggag

SEQ ID NO: 53423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagccaggagaggaacat

SEQ ID NO: 53424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaggagaggaacatcaga

SEQ ID NO: 53425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcagaaagacacaaaaata

SEQ ID NO: 53426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacacaaaaatacagaaaaa

SEQ ID NO: 53427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaacagacatttgcacaa

SEQ ID NO: 53428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacatttgcacaatagtttt

SEQ ID NO: 53429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcacaatagttttgagaa

SEQ ID NO: 53430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattgtttgaacctcacac

SEQ ID NO: 53431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtttgaacctcacactaga

SEQ ID NO: 53432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacactagacagaactctg

SEQ ID NO: 53433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acactagacagaactctgaa

SEQ ID NO: 53434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagacagaactctgaagaga

SEQ ID NO: 53435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcaaatgaaaaaataaaa

SEQ ID NO: 53436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcaaatgaaaaaataaaat

SEQ ID NO: 53437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcaaatgaaaaaataaaata

SEQ ID NO: 53438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaaataaaatagggaat

SEQ ID NO: 53439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaataaaatagggaatt

SEQ ID NO: 53440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaaatagggaattgggac

SEQ ID NO: 53441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaatagggaattgggact

SEQ ID NO: 53442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatagggaattgggactgg

SEQ ID NO: 53443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggaattgggactgggagt

SEQ ID NO: 53444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccactttttaaaatatttt

SEQ ID NO: 53445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaatatttttagttatta

SEQ ID NO: 53446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacagtgatgctgaactaat

SEQ ID NO: 53447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatgctgaactaataagaa

SEQ ID NO: 53448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaactaataagaatggtgtt

SEQ ID NO: 53449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actaataagaatggtgttta

SEQ ID NO: 53450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taataagaatggtgtttaga

SEQ ID NO: 53451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggtgtttagagagaacat

SEQ ID NO: 53452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtttagagagaacataag

SEQ ID NO: 53453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttagagagaacataagaa

SEQ ID NO: 53454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacataagaagagtaaattt

SEQ ID NO: 53455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataagaagagtaaatttga

SEQ ID NO: 53456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagagtctgtctaaaatctt

SEQ ID NO: 53457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtctgtctaaaatcttt

SEQ ID NO: 53458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtctaaaatctttaggcac

SEQ ID NO: 53459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcactcttgccgtcttta

SEQ ID NO: 53460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttcttcttattctcctt

SEQ ID NO: 53461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttcttcttattctccttt

SEQ ID NO: 53462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgggatcttttattttttt

SEQ ID NO: 53463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaattacacctacaacttc

SEQ ID NO: 53464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatataaaatactttaa

SEQ ID NO: 53465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatataaaatactttaat

SEQ ID NO: 53466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatactttaataggacatc

SEQ ID NO: 53467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggacatcaagtaattattt

SEQ ID NO: 53468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagtaattatttcagaata

SEQ ID NO: 53469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacagatgaaaataatttca

SEQ ID NO: 53470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatagcattgtcctaaatc

SEQ ID NO: 53471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagcattgtcctaaatcca

SEQ ID NO: 53472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagcattgtcctaaatccag

SEQ ID NO: 53473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcattgtcctaaatccaga

SEQ ID NO: 53474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttcatgaatcattgctct

SEQ ID NO: 53475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgaatcattgctcttaga

SEQ ID NO: 53476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttagaaagctcttgacacc

SEQ ID NO: 53477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagaaagctcttgacaccc

SEQ ID NO: 53478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagaaagctcttgacaccca

SEQ ID NO: 53479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaaagctcttgacacccag

SEQ ID NO: 53480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctcttgacacccagggga

SEQ ID NO: 53481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctcttgacacccaggggat

SEQ ID NO: 53482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaggggataggttttcatg

SEQ ID NO: 53483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcatgcagaaaatcaccc

SEQ ID NO: 53484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcatgcagaaaatcaccct

SEQ ID NO: 53485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgcagaaaatcaccctgg

SEQ ID NO: 53486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccctgggagatcaacatgcc

SEQ ID NO: 53487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggagatcaacatgcctag

SEQ ID NO: 53488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttgatgtacctcatgtac

SEQ ID NO: 53489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgtttgtttctcctgact

SEQ ID NO: 53490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtttctcctgacttagta

SEQ ID NO: 53491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttctcctgacttagtaaa

SEQ ID NO: 53492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacttagtaaagagctattt

SEQ ID NO: 53493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagtaaagagctatttaag

SEQ ID NO: 53494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagctatttaagtggacccc

SEQ ID NO: 53495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatttaagtggacccctggt

SEQ ID NO: 53496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttaagtggacccctggtt

SEQ ID NO: 53497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttaagtggacccctggttg

SEQ ID NO: 53498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagtggacccctggttggg

SEQ ID NO: 53499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtggacccctggttgggg

SEQ ID NO: 53500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggacccctggttggggagga

SEQ ID NO: 53501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggttggggaggaaagcctt

SEQ ID NO: 53502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccttgagttctgtgctatt

SEQ ID NO: 53503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taatgttcacaacacacctg

SEQ ID NO: 53504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actattccatcatttttcct

SEQ ID NO: 53505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctgagtaataaacacatt

SEQ ID NO: 53506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacattaagactttatatg

SEQ ID NO: 53507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtaatcaataaatgatgaca

SEQ ID NO: 53508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgacacggaaaacaaatc

SEQ ID NO: 53509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgacacggaaaacaaatcc

SEQ ID NO: 53510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacggaaaacaaatccagg

SEQ ID NO: 53511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggaagtgtctaaattacc

SEQ ID NO: 53512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaaattacctggaattcac

SEQ ID NO: 53513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattacctggaattcactgg

SEQ ID NO: 53514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actggtagccaatcgtaacc

SEQ ID NO: 53515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taacccagccccattcttca

SEQ ID NO: 53516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacccagccccattcttcac

SEQ ID NO: 53517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccattcttcacaggcattta

SEQ ID NO: 53518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcatttaaagttcatgcca

SEQ ID NO: 53519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttcatgccacagaattta

SEQ ID NO: 53520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcatgccacagaatttaaa

SEQ ID NO: 53521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatgccacagaatttaaag

SEQ ID NO: 53522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggctgttacactctgatc

SEQ ID NO: 53523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatctagaacttgtataat

SEQ ID NO: 53524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatctagaacttgtataata

SEQ ID NO: 53525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgtataataaggtcatg

SEQ ID NO: 53526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtataataaggtcatgaa

SEQ ID NO: 53527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaggtcatgaagagaca

SEQ ID NO: 53528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaggtcatgaagagacaa

SEQ ID NO: 53529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggtcatgaagagacaaag

SEQ ID NO: 53530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtcatgaagagacaaagg

SEQ ID NO: 53531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatttaaaaaaaaacaca

SEQ ID NO: 53532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatttaaaaaaaaacacat

SEQ ID NO: 53533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaaaaaaaacacataggat

SEQ ID NO: 53534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaaacacataggatcg

SEQ ID NO: 53535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacacataggatcggagtgc

SEQ ID NO: 53536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgccagataaaataca

SEQ ID NO: 53537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagataaaatacatggtgtc

SEQ ID NO: 53538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctagtcatatttgaattc

SEQ ID NO: 53539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcatatttgaattccagat

SEQ ID NO: 53540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttgaattccagataagtc

SEQ ID NO: 53541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgaattccagataagtcc

SEQ ID NO: 53542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agataagtccaggacctaca

SEQ ID NO: 53543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataagtccaggacctacat

SEQ ID NO: 53544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaggacctacataggaaat

SEQ ID NO: 53545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaaattggcaacttttca

SEQ ID NO: 53546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaattggcaacttttcac

SEQ ID NO: 53547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacttttcacaggcatgttc

SEQ ID NO: 53548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttcacaggcatgttccag

SEQ ID NO: 53549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcacaggcatgttccaga

SEQ ID NO: 53550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaccaaacctttttccta

SEQ ID NO: 53551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaacctttttcctatggc

SEQ ID NO: 53552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctttttcctatggcaaga

SEQ ID NO: 53553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttcctatggcaagatgg

SEQ ID NO: 53554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttcctatggcaagatggt

SEQ ID NO: 53555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcaagatggtaggttcttc

SEQ ID NO: 53556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcttctctgctaacaatctg

SEQ ID NO: 53557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgctaacaatctgtggctc

SEQ ID NO: 53558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctaacaatctgtggctcca

SEQ ID NO: 53559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacaatctgtggctccaga

SEQ ID NO: 53560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacaatctgtggctccagag

SEQ ID NO: 53561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatctgtggctccagagagg

SEQ ID NO: 53562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgtggctccagagaggaa

SEQ ID NO: 53563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgtggctccagagaggaag

SEQ ID NO: 53564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctccagagaggaagaggc

SEQ ID NO: 53565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctccagagaggaagaggcaa

SEQ ID NO: 53566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccagagaggaagaggcaag

SEQ ID NO: 53567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaagaggcaagaggatgc

SEQ ID NO: 53568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaagaggcaagaggatgcc

SEQ ID NO: 53569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaggcaagaggatgccagg

SEQ ID NO: 53570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaggtagcatgtaactcat

SEQ ID NO: 53571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actcatgagccaatgaaaat

SEQ ID NO: 53572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattagttaatataccacct

SEQ ID NO: 53573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ccaccttagcacatgtgtaa

SEQ ID NO: 53574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtacatttttcctacaaact

SEQ ID NO: 53575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttcctacaaactaagaa

SEQ ID NO: 53576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctacaaactaagaataga

SEQ ID NO: 53577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattaaaaaaaaaaaatgac

SEQ ID NO: 53578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaaaaaaaaatgacaag

SEQ ID NO: 53579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgacaagtagctattttc

SEQ ID NO: 53580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caagtagctattttccagcc

SEQ ID NO: 53581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagcctagatatgcccctc

SEQ ID NO: 53582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccgctcatttaaatgattgc

SEQ ID NO: 53583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatttaaatgattgccagt

SEQ ID NO: 53584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaaatgattgccagtcag

SEQ ID NO: 53585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgattgccagtcagtagc

SEQ ID NO: 53586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgccagtcagtagccagtgc

SEQ ID NO: 53587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagccagtgctagtaataaa

SEQ ID NO: 53588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaagtaccatttactccc

SEQ ID NO: 53589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaagtaccatttactccct

SEQ ID NO: 53590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatttactccctgggaact

SEQ ID NO: 53591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactccctgggaactcagaa

SEQ ID NO: 53592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctccctgggaactcagaata

SEQ ID NO: 53593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagagtaacatctaatcaac

SEQ ID NO: 53594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtaacatctaatcaaca

SEQ ID NO: 53595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagtaacatctaatcaacaa

SEQ ID NO: 53596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttatctgtactatcacaa

SEQ ID NO: 53597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtactatcacaatggtctcc

SEQ ID NO: 53598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaatggtctccaagtctc

SEQ ID NO: 53599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaatggtctccaagtctct

SEQ ID NO: 53600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctcattttgtcttatcca

SEQ ID NO: 53601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtcttatccacagaatata

SEQ ID NO: 53602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacagaatatatagtactgt

SEQ ID NO: 53603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagaatatatagtactgtca

SEQ ID NO: 53604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatatagtactgtcagag

SEQ ID NO: 53605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttctgttaaaaaatcat

SEQ ID NO: 53606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctgttaaaaaatcatcag

SEQ ID NO: 53607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatcatcagtggcttctcaa

SEQ ID NO: 53608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtggcttctcaatagctta

SEQ ID NO: 53609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtggcttctcaatagcttat

SEQ ID NO: 53610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcttatgggattaacccac

SEQ ID NO: 53611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcttatgggattaacccaca

SEQ ID NO: 53612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttatgggattaacccacaa

SEQ ID NO: 53613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacccacaagggcctgtcct

SEQ ID NO: 53614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccacaagggcctgtcctaag

SEQ ID NO: 53615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggcctgtcctaagtggtcc

SEQ ID NO: 53616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcattcccacccacctatc

SEQ ID NO: 53617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcattcccacccacctatct

SEQ ID NO: 53618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacccacctatctaggactc

SEQ ID NO: 53619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctatctaggactcaagatcc

SEQ ID NO: 53620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaggactcaagatcctaga

SEQ ID NO: 53621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggactcaagatcctagat

SEQ ID NO: 53622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gactcaagatcctagatagg

SEQ ID NO: 53623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gataggtggctatgctccaa

SEQ ID NO: 53624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataggtggctatgctccaat

SEQ ID NO: 53625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggtggctatgctccaata

SEQ ID NO: 53626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggcattttaattcttccct

SEQ ID NO: 53627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcattttaattcttccctc

SEQ ID NO: 53628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattttaattcttccctcag

SEQ ID NO: 53629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaattcttccctcaggagc

SEQ ID NO: 53630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttccctcaggagccagtcc

SEQ ID NO: 53631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccctcaggagccagtccaa

SEQ ID NO: 53632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacttttcttaaacctcca

SEQ ID NO: 53633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttcttaaacctccaaag

SEQ ID NO: 53634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcttaaacctccaaagtag

SEQ ID NO: 53635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaacctccaaagtagtggc

SEQ ID NO: 53636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacctccaaagtagtggcc

SEQ ID NO: 53637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccaaagtagtggccgggtg

SEQ ID NO: 53638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagtagtggccgggtgcag

SEQ ID NO: 53639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtctgtaatcccaacactt

SEQ ID NO: 53640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtctgtaatcccaacacttt

SEQ ID NO: 53641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccaacactttgg

SEQ ID NO: 53642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccaacactttggg

SEQ ID NO: 53643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcccaacactttgggagg

SEQ ID NO: 53644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccaacactttgggaggca

SEQ ID NO: 53645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaacactttgggaggcag

SEQ ID NO: 53646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacactttgggaggcagagg

SEQ ID NO: 53647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acactttgggaggcagaggt

SEQ ID NO: 53648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgggaggcagaggtggg

SEQ ID NO: 53649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagaggtgggcagatcactt

SEQ ID NO: 53650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaggtgggcagatcacttg

SEQ ID NO: 53651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtgggcagatcacttgaggt

SEQ ID NO: 53652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcagatcacttgaggtcgg

SEQ ID NO: 53653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacttgaggtcggaagttc

SEQ ID NO: 53654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaggtcggaagttcaagac

SEQ ID NO: 53655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagaccagcctgaccaaca

SEQ ID NO: 53656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaccagcctgaccaacatg

SEQ ID NO: 53657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactaaaaaaaatacaaaat

SEQ ID NO: 53658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaaaaaatacaaaattagc

SEQ ID NO: 53659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaaatacaaaattagcc

SEQ ID NO: 53660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatacaaaattagccgggcg

SEQ ID NO: 53661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattagccgggcgtgg

SEQ ID NO: 53662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtggcgcgtgcttataatcc

SEQ ID NO: 53663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgcttataatcccggctcct

SEQ ID NO: 53664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttataatcccggctcctcgg

SEQ ID NO: 53665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataatcccggctcctcgga

SEQ ID NO: 53666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccggctcctcggaaggct

SEQ ID NO: 53667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccggctcctcggaaggctg

SEQ ID NO: 53668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggctcctcggaaggctgagg

SEQ ID NO: 53669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctcctcggaaggctgaggc

SEQ ID NO: 53670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctcggaaggctgaggcag

SEQ ID NO: 53671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggagaatcgcttgaacc

SEQ ID NO: 53672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggagaatcgcttgaaccc

SEQ ID NO: 53673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatcgcttgaacccag

SEQ ID NO: 53674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaatcgcttgaacccaggag

SEQ ID NO: 53675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcgcttgaacccaggagcg

SEQ ID NO: 53676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaacccaggagcggagattg

SEQ ID NO: 53677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaggagcggagattgcggt

SEQ ID NO: 53678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcggagattgcggtgagcc

SEQ ID NO: 53679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatcacgccattgcactt

SEQ ID NO: 53680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatcacgccattgcacttc

SEQ ID NO: 53681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacgccattgcacttcagga

SEQ ID NO: 53682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acgccattgcacttcaggat

SEQ ID NO: 53683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcacttcaggatgggcaac

SEQ ID NO: 53684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacttcaggatgggcaacaa

SEQ ID NO: 53685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacataatcaccctccccc

SEQ ID NO: 53686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catctttctactcccatatt

SEQ ID NO: 53687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tactcccatatttagcccaa

SEQ ID NO: 53688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actcccatatttagcccaat

SEQ ID NO: 53689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcccatatttagcccaatg

SEQ ID NO: 53690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttagcccaatggggtaca

SEQ ID NO: 53691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcccaatggggtacatag

SEQ ID NO: 53692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcccaatggggtacataga

SEQ ID NO: 53693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaatcaataaatacttatt

SEQ ID NO: 53694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctattccttactttaaa

SEQ ID NO: 53695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattccttactttaaaaag

SEQ ID NO: 53696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattccttactttaaaaaga

SEQ ID NO: 53697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttactttaaaaagaaggaaa

SEQ ID NO: 53698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaagaaggaaacagaaa

SEQ ID NO: 53699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaaggaaacagaaaaagt

SEQ ID NO: 53700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaaacagaaaaagtgaga

SEQ ID NO: 53701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaacagaaaaagtgagaaa

SEQ ID NO: 53702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaaagagttcaaaatgt

SEQ ID NO: 53703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaaagagttcaaaatgta

SEQ ID NO: 53704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatgtaaggaaccaatga

SEQ ID NO: 53705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggaaccaatgaaagaaa

SEQ ID NO: 53706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaatgaaagaaaaagaaaa

SEQ ID NO: 53707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaaagaaaaaagtcaca

SEQ ID NO: 53708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagtcacaaagttatgtaat

SEQ ID NO: 53709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgttatcattttctaaa

SEQ ID NO: 53710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttccacttcattttgcaatt

SEQ ID NO: 53711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccacttcattttgcaattt

SEQ ID NO: 53712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacttcattttgcaatttag

SEQ ID NO: 53713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaatttaggagtatttcaa

SEQ ID NO: 53714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaggagtatttcaatggt

SEQ ID NO: 53715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggagtatttcaatggtca

SEQ ID NO: 53716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaatggtcagagaaaatga

SEQ ID NO: 53717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtactgttaattctgaaaat

SEQ ID NO: 53718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctctacaaacttttaaat

SEQ ID NO: 53719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctacaaacttttaaatt

SEQ ID NO: 53720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaatattcctaaaaaccct

SEQ ID NO: 53721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattcctaaaaaccctaag

SEQ ID NO: 53722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaccctaagtagactat

SEQ ID NO: 53723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaccctaagtagactata

SEQ ID NO: 53724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaccctaagtagactataa

SEQ ID NO: 53725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctataagggcaatgcattat

SEQ ID NO: 53726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataagggcaatgcattata

SEQ ID NO: 53727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agggcaatgcattataaggc

SEQ ID NO: 53728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcaatgcattataaggcta

SEQ ID NO: 53729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccgtgtatataacaatacct

SEQ ID NO: 53730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tatataacaatacctcagac

SEQ ID NO: 53731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atataacaatacctcagacc

SEQ ID NO: 53732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaatacctcagaccgggca

SEQ ID NO: 53733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacctcagaccgggcatgg

SEQ ID NO: 53734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctgtaatcc

SEQ ID NO: 53735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctgtaatcccagcactt

SEQ ID NO: 53736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtaatcccagcactttgg

SEQ ID NO: 53737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagcactttgga

SEQ ID NO: 53738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcactttggaaggcc

SEQ ID NO: 53739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttggaaggccg

SEQ ID NO: 53740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcactttggaaggccgagg

SEQ ID NO: 53741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcactttggaaggccgaggc

SEQ ID NO: 53742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttggaaggccgaggcagg

SEQ ID NO: 53743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgaggcaggtggatcacctg

SEQ ID NO: 53744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcaggtggatcacctgaagt

SEQ ID NO: 53745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggtggatcacctgaagtc

SEQ ID NO: 53746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtggatcacctgaagtcgg

SEQ ID NO: 53747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacctgaagtcgggagttc

SEQ ID NO: 53748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaagtcgggagttcgagac

SEQ ID NO: 53749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgagaccagtctgaccaaca

SEQ ID NO: 53750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaccagtctgaccaacatg

SEQ ID NO: 53751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctactaaaaatacaaaat

SEQ ID NO: 53752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaaaaatacaaaattagc

SEQ ID NO: 53753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaaaatacaaaattagcc

SEQ ID NO: 53754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatacaaaattagccaggcg

SEQ ID NO: 53755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattagccaggcgtgg

SEQ ID NO: 53756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaattagccaggcgtggt

SEQ ID NO: 53757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaattagccaggcgtggtg

SEQ ID NO: 53758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggggcatgcctgtaatcc

SEQ ID NO: 53759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcctgtaatcccagctact

SEQ ID NO: 53760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcctgtaatcccagctactc

SEQ ID NO: 53761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccagctactcag

SEQ ID NO: 53762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagctactcagg

SEQ ID NO: 53763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctactcaggaggct

SEQ ID NO: 53764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctactcaggaggctg

SEQ ID NO: 53765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctactcaggaggctgagg

SEQ ID NO: 53766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactcaggaggctgaggcag

SEQ ID NO: 53767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagaagaattgcttgaacc

SEQ ID NO: 53768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagaagaattgcttgaacct

SEQ ID NO: 53769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagaattgcttgaacctgg

SEQ ID NO: 53770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaattgcttgaacctggg

SEQ ID NO: 53771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aattgcttgaacctgggagg

SEQ ID NO: 53772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcttgaacctgggaggcg

SEQ ID NO: 53773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcttgaacctgggaggcgg

SEQ ID NO: 53774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacctgggaggcggaggttg

SEQ ID NO: 53775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggaggcggaggttgtggc

SEQ ID NO: 53776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcggaggttgtggcgagcc

SEQ ID NO: 53777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagattgcgccattgcactc

SEQ ID NO: 53778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcgccattgcactccagcc

SEQ ID NO: 53779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcgccattgcactccagcct

SEQ ID NO: 53780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcactccagcctgggcaac

SEQ ID NO: 53781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactccagcctgggcaacaa

SEQ ID NO: 53782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaataaaattaacatgct

SEQ ID NO: 53783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgaaaacttttctactcc

SEQ ID NO: 53784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttttctactcctggttcg

SEQ ID NO: 53785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacttcctctgccataatta

SEQ ID NO: 53786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgccataattaaagtatctc

SEQ ID NO: 53787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccataattaaagtatctct

SEQ ID NO: 53788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgattctattattcctgca

SEQ ID NO: 53789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcctgcatggataatttac

SEQ ID NO: 53790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggataatttaccagtaattc

SEQ ID NO: 53791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaattcaagctttttatgt

SEQ ID NO: 53792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taattcaagctttttatgta

SEQ ID NO: 53793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attcaagctttttatgtaag

SEQ ID NO: 53794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagctttttatgtaagga

SEQ ID NO: 53795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagctttttatgtaaggaga

SEQ ID NO: 53796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgtaaggagagagattat

SEQ ID NO: 53797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagattatcagaaaaacta

SEQ ID NO: 53798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagattatcagaaaaactat

SEQ ID NO: 53799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agattatcagaaaaactatg

SEQ ID NO: 53800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaactatggggatgcccctc

SEQ ID NO: 53801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactatggggatgcccctcc

SEQ ID NO: 53802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttcattttcattcttgtc

SEQ ID NO: 53803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttcattttcattcttgtct

SEQ ID NO: 53804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgggcattctgcctttaa

SEQ ID NO: 53805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgtaatgtccccaccact

SEQ ID NO: 53806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accacttggtttcatgaaac

SEQ ID NO: 53807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccacttggtttcatgaaact

SEQ ID NO: 53808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggtatccctatatgtgcct

SEQ ID NO: 53809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaaaacacaacaaaatta

SEQ ID NO: 53810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaacaaaattatagttgc

SEQ ID NO: 53811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccttcatctctgctgattt

SEQ ID NO: 53812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttcatctctgctgatttt

SEQ ID NO: 53813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgctgattttaggaatt

SEQ ID NO: 53814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttaggaattcagaaattt

SEQ ID NO: 53815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attcagaaatttaagaatat

SEQ ID NO: 53816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaaatttaagaatatgag

SEQ ID NO: 53817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatatgagaagttttgatt

SEQ ID NO: 53818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatatgagaagttttgattt

SEQ ID NO: 53819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatgagaagttttgatttg

SEQ ID NO: 53820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaagttttgatttgggg

SEQ ID NO: 53821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagttttgatttggggaa

SEQ ID NO: 53822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagttttgatttggggaag

SEQ ID NO: 53823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatttggggaagaggaat

SEQ ID NO: 53824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaagaggaattagtatgca

SEQ ID NO: 53825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagaggaattagtatgcat

SEQ ID NO: 53826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagaggaattagtatgcata

SEQ ID NO: 53827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaggaattagtatgcatag

SEQ ID NO: 53828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcataggggtatactt

SEQ ID NO: 53829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactatgcccactattatcc

SEQ ID NO: 53830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcctagacacattgaatt

SEQ ID NO: 53831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacacattgaattgagctct

SEQ ID NO: 53832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaattttgtctgtaaat

SEQ ID NO: 53833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgtctgtaaataagaat

SEQ ID NO: 53834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaattagaactatattttat

SEQ ID NO: 53835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattagaactatattttatg

SEQ ID NO: 53836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatgaggtcacttttaact

SEQ ID NO: 53837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtcaatcatcttgcccac

SEQ ID NO: 53838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttgcccactggtgatcac

SEQ ID NO: 53839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgcccactggtgatcacc

SEQ ID NO: 53840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcccactggtgatcacca

SEQ ID NO: 53841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactggtgatcaccagggaa

SEQ ID NO: 53842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actggtgatcaccagggaaa

SEQ ID NO: 53843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcaccagggaaaaggcaa

SEQ ID NO: 53844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaccagggaaaaggcaaa

SEQ ID NO: 53845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaggcaaaaggttattca

SEQ ID NO: 53846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggttattcaaagctcaaa

SEQ ID NO: 53847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagctcaaaaagaacatttt

SEQ ID NO: 53848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaagtatatgtattacat

SEQ ID NO: 53849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aagtatatgtattacatcag

SEQ ID NO: 53850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgtattacatcagcggct

SEQ ID NO: 53851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcatgtgtattaaaatgtg

SEQ ID NO: 53852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcatgtgtattaaaatgtga

SEQ ID NO: 53853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catgtgtattaaaatgtgaa

SEQ ID NO: 53854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgtattaaaatgtgaaggg

SEQ ID NO: 53855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcagtatattattaatcaa

SEQ ID NO: 53856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtatattattaatcaaaaga

SEQ ID NO: 53857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaaaagatggttataact

SEQ ID NO: 53858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaaagatggttataactaa

SEQ ID NO: 53859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatggttataactaagagt

SEQ ID NO: 53860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttataactaagagtaagaaa

SEQ ID NO: 53861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataactaagagtaagaaac

SEQ ID NO: 53862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttcaactacaaatata

SEQ ID NO: 53863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaagcgaatgctattttga

SEQ ID NO: 53864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacattattttaacaaaaa

SEQ ID NO: 53865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaacaaaaaaagcttttt

SEQ ID NO: 53866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacaaaaaaagctttttca

SEQ ID NO: 53867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagctttttcagagtgct

SEQ ID NO: 53868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagctttttcagagtgctaa

SEQ ID NO: 53869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgcctgctctctatatat

SEQ ID NO: 53870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgctctctatatataagca

SEQ ID NO: 53871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tataagcacagacgcacaca

SEQ ID NO: 53872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacatacacacatatttcct

SEQ ID NO: 53873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacacacatatttcctaag

SEQ ID NO: 53874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttcctaagtagacactt

SEQ ID NO: 53875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacttaagacattcatatct

SEQ ID NO: 53876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttttaaaaaaatctgatt

SEQ ID NO: 53877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatctgatttggcgacaca

SEQ ID NO: 53878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatctgatttggcgacacaa

SEQ ID NO: 53879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggcgacacaaaggcttcc

SEQ ID NO: 53880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggcgacacaaaggcttcca

SEQ ID NO: 53881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggcgacacaaaggcttccaa

SEQ ID NO: 53882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacacaaaggcttccaaggg

SEQ ID NO: 53883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatttaacaaaatatcttg

SEQ ID NO: 53884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatatcttgaagtcttg

SEQ ID NO: 53885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaagtcttgaagcatgaa

SEQ ID NO: 53886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagcatgaaaagcctaaa

SEQ ID NO: 53887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatgaaaagcctaaaaag

SEQ ID NO: 53888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaacaaaaacccacacat

SEQ ID NO: 53889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaacaaaaacccacacatc

SEQ ID NO: 53890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaaaaacccacacatca

SEQ ID NO: 53891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaacccacacatcaggg

SEQ ID NO: 53892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacatcagggtggtgaaat

SEQ ID NO: 53893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcagggtggtgaaatgaga

SEQ ID NO: 53894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggtggtgaaatgagaaagt

SEQ ID NO: 53895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagaaacattttccttata

SEQ ID NO: 53896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaaccacacaattacttta

SEQ ID NO: 53897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaattgcttcctgcaact

SEQ ID NO: 53898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcttcctgcaactgagct

SEQ ID NO: 53899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcttcctgcaactgagctg

SEQ ID NO: 53900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcaactgagctgaggaatt

SEQ ID NO: 53901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaactgagctgaggaattt

SEQ ID NO: 53902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caactgagctgaggaattta

SEQ ID NO: 53903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttagggatgatatgtgtca

SEQ ID NO: 53904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagggatgatatgtgtcaa

SEQ ID NO: 53905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaacatgtttctttttc

SEQ ID NO: 53906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgtttctttttcaagcaa

SEQ ID NO: 53907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttttcaagcaaaagatg

SEQ ID NO: 53908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttttcaagcaaaagatgt

SEQ ID NO: 53909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaaaagatgtgggtcatg

SEQ ID NO: 53910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagatgtgggtcatgtggt

SEQ ID NO: 53911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagatgtgggtcatgtggta

SEQ ID NO: 53912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttctattgcaatatcttca

SEQ ID NO: 53913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcatggctctcttgccaa

SEQ ID NO: 53914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatttaatcactttatctaa

SEQ ID NO: 53915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaatggatgtgatttcta

SEQ ID NO: 53916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggatgtgatttctaaagtca

SEQ ID NO: 53917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgatttctaaagtcacagt

SEQ ID NO: 53918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaagtcacagttagccat

SEQ ID NO: 53919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaagtcacagttagccatt

SEQ ID NO: 53920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcacagttagccattagga

SEQ ID NO: 53921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattaggaaagctcttgctc

SEQ ID NO: 53922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaagctcttgctctggtt

SEQ ID NO: 53923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctcttgctctggttcagct

SEQ ID NO: 53924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattacatttcctgactttg

SEQ ID NO: 53925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttcctgactttgtggttt

SEQ ID NO: 53926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcctgactttgtggtttca

SEQ ID NO: 53927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgactttgtggtttcagag

SEQ ID NO: 53928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actttgtggtttcagagaag

SEQ ID NO: 53929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgtggtttcagagaagca

SEQ ID NO: 53930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtttcagagaagcagagc

SEQ ID NO: 53931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcagagaagcagagctgg

SEQ ID NO: 53932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagagaagcagagctggtg

SEQ ID NO: 53933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagctggtggagaattccc

SEQ ID NO: 53934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctggtggagaattccctggc

SEQ ID NO: 53935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattccctggctggattcat

SEQ ID NO: 53936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggattcatcagtctttgcta

SEQ ID NO: 53937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcagtctttgctatggac

SEQ ID NO: 53938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagtctttgctatggacaa

SEQ ID NO: 53939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgctatggacaagagaata

SEQ ID NO: 53940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatggacaagagaatacagt

SEQ ID NO: 53941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatacagtaagaccatcc

SEQ ID NO: 53942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtaagaccatccaagtcat

SEQ ID NO: 53943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accatccaagtcattagtct

SEQ ID NO: 53944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccatccaagtcattagtctt

SEQ ID NO: 53945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catccaagtcattagtcttg

SEQ ID NO: 53946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atccaagtcattagtcttgg

SEQ ID NO: 53947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtcattagtcttgggggt

SEQ ID NO: 53948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtcattagtcttgggggtt

SEQ ID NO: 53949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattagtcttgggggttggg

SEQ ID NO: 53950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggtagattcactacatcc

SEQ ID NO: 53951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcactacatccaagtctt

SEQ ID NO: 53952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcactacatccaagtcttta

SEQ ID NO: 53953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatccaagtctttagagcc

SEQ ID NO: 53954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttagagccaagtgcccata

SEQ ID NO: 53955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggctaactttaattacta

SEQ ID NO: 53956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taactttaattactatagaa

SEQ ID NO: 53957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattcttacccttcttgat

SEQ ID NO: 53958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttacccttcttgattagat

SEQ ID NO: 53959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggaaacaaatctcatta

SEQ ID NO: 53960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggaaacaaatctcattatg

SEQ ID NO: 53961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttttaaataattaccatg

SEQ ID NO: 53962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatcaacctgataccatct

SEQ ID NO: 53963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgaaaaaatttaaattc

SEQ ID NO: 53964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaatttaaattcaagta

SEQ ID NO: 53965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgatatgtttactgttgt

SEQ ID NO: 53966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtttactgttgtaagata

SEQ ID NO: 53967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagatacagtaaaaaatgt

SEQ ID NO: 53968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atacagtaaaaaatgtaagt

SEQ ID NO: 53969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtaaaaaatgtaagtgagc

SEQ ID NO: 53970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagctagaatatatcacaaa

SEQ ID NO: 53971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctattgtcttcattcta

SEQ ID NO: 53972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcattctatggcgtttctt

SEQ ID NO: 53973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacacgtacaatgttaaaa

SEQ ID NO: 53974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgacatctcaaaaaaaat

SEQ ID NO: 53975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagccctaaacccgtaaaa

SEQ ID NO: 53976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagccctaaacccgtaaaat

SEQ ID NO: 53977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agccctaaacccgtaaaatg

SEQ ID NO: 53978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctaaacccgtaaaatggg

SEQ ID NO: 53979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatggggagaaaaaactata

SEQ ID NO: 53980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggagaaaaaactataaagt

SEQ ID NO: 53981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactataaagttggtatat

SEQ ID NO: 53982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaagttggtatattggt

SEQ ID NO: 53983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctattataatgtgaatga

SEQ ID NO: 53984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attataatgtgaatgacagt

SEQ ID NO: 53985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaatgacagtaagatttaca

SEQ ID NO: 53986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttacacggccctacttttaa

SEQ ID NO: 53987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccctacttttaacagcctga

SEQ ID NO: 53988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcctgacagaaaattta

SEQ ID NO: 53989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctgacagaaaatttacag

SEQ ID NO: 53990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agataaatctatactactca

SEQ ID NO: 53991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatggatttatctgactta

SEQ ID NO: 53992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatggatgattccccttta

SEQ ID NO: 53993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagactgttctattcaata

SEQ ID NO: 53994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatgcattcctttgctac

SEQ ID NO: 53995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcattcctttgctacaagac

SEQ ID NO: 53996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgctacaagaccagaaata

SEQ ID NO: 53997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaatgtgatctaaataac

SEQ ID NO: 53998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatctaaataacaagttaaa

SEQ ID NO: 53999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttaaaaagataaaacacca

SEQ ID NO: 54000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaccatggtaaattaatga

SEQ ID NO: 54001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgatggtgataaatgtaat

SEQ ID NO: 54002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtaataagcctacaataa

SEQ ID NO: 54003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taataagcctacaataaaag

SEQ ID NO: 54004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctacaataaaagcagactg

SEQ ID NO: 54005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caataaaagcagactgcagt

SEQ ID NO: 54006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgcagtaagactgaaact

SEQ ID NO: 54007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaaactaagaaaccaaat

SEQ ID NO: 54008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaactaagaaaccaaata

SEQ ID NO: 54009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagaaaccaaataaggcat

SEQ ID NO: 54010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaccaaataaggcattagc

SEQ ID NO: 54011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaccaaataaggcattagca

SEQ ID NO: 54012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaccttacattctgtactg

SEQ ID NO: 54013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacattctgtactgaagta

SEQ ID NO: 54014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaagtatagaaatattatt

SEQ ID NO: 54015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagtatagaaatattattt

SEQ ID NO: 54016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatagaaatattatttagga

SEQ ID NO: 54017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaatattatttaggaaagc

SEQ ID NO: 54018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaacatcaatcattaatta

SEQ ID NO: 54019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcgtatatgcaccttcat

SEQ ID NO: 54020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaaaaatgttttctccaa

SEQ ID NO: 54021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaaaaatgttttctccaat

SEQ ID NO: 54022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaatgggttaattttttct

SEQ ID NO: 54023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggttaattttttcttagttg

SEQ ID NO: 54024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttagttgcagtaacattg

SEQ ID NO: 54025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttagttgcagtaacattgt

SEQ ID NO: 54026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattcttctatatactgatc

SEQ ID NO: 54027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagatacttttcctacaca

SEQ ID NO: 54028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttttcctacacacagcat

SEQ ID NO: 54029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcctacacacagcataag

SEQ ID NO: 54030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacagcataagaagatatt

SEQ ID NO: 54031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccacgttaatcaaactgaa

SEQ ID NO: 54032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgttaatcaaactgaaaagt

SEQ ID NO: 54033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaaactgaaaagtaagac

SEQ ID NO: 54034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaactgaaaagtaagaca

SEQ ID NO: 54035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagacaaggaattccaaat

SEQ ID NO: 54036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacaaggaattccaaatca

SEQ ID NO: 54037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttccaaatcagagcctattt

SEQ ID NO: 54038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagcctattttagaactat

SEQ ID NO: 54039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tatgagcattcaactgaaaa

SEQ ID NO: 54040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgagcattcaactgaaaac

SEQ ID NO: 54041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaactgaaaacgggtctc

SEQ ID NO: 54042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgccaccaacaattgataat

SEQ ID NO: 54043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattggtatcatttttgtgc

SEQ ID NO: 54044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtatcatttttgtgcaagt

SEQ ID NO: 54045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaagtgagatgtgccttgt

SEQ ID NO: 54046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgttagtgctttttaactt

SEQ ID NO: 54047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttttaacttgagtgtttg

SEQ ID NO: 54048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaactgttttctctaaacc

SEQ ID NO: 54049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctctaaaccaagatttaa

SEQ ID NO: 54050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaccaagatttaaaagttc

SEQ ID NO: 54051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaccaagatttaaaagttcc

SEQ ID NO: 54052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacaaatttcttttgaaaa

SEQ ID NO: 54053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaaagatctgtgctttc

SEQ ID NO: 54054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaagatctgtgctttct

SEQ ID NO: 54055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatctgtgctttctgggcg

SEQ ID NO: 54056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgtgctttctgggcgtgg

SEQ ID NO: 54057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctaatgtctgtaatcc

SEQ ID NO: 54058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtctgtaatcccagcactt

SEQ ID NO: 54059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtctgtaatcccagcacttt

SEQ ID NO: 54060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccagcactttgg

SEQ ID NO: 54061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagcactttggg

SEQ ID NO: 54062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccagcactttgggaggccg

SEQ ID NO: 54063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcactttgggaggccgaag

SEQ ID NO: 54064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttgggaggccgaagt

SEQ ID NO: 54065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgggaggccgaagtggg

SEQ ID NO: 54066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgaagtgggcagatcactt

SEQ ID NO: 54067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgaagtgggcagatcacttg

SEQ ID NO: 54068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgggcagatcacttgaggt

SEQ ID NO: 54069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggcagatcacttgaggtc

SEQ ID NO: 54070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcagatcacttgaggtcag

SEQ ID NO: 54071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacttgaggtcaggagttc

SEQ ID NO: 54072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaggtcaggagttcaagtc

SEQ ID NO: 54073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccttcaaaaatacaaaaa

SEQ ID NO: 54074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcaaaaatacaaaaatagt

SEQ ID NO: 54075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtttccaaaaaaaaaaaa

SEQ ID NO: 54076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttccaaaaaaaaaaaaaa

SEQ ID NO: 54077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaagagaaaa

SEQ ID NO: 54078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaaaaaagagaaaaaa

SEQ ID NO: 54079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaatgccttaaaacatt

SEQ ID NO: 54080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatttagttgcctaacacc

SEQ ID NO: 54081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagttgcctaacaccaagc

SEQ ID NO: 54082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatattcattcaatgaac

SEQ ID NO: 54083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatattcattcaatgaacaa

SEQ ID NO: 54084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagagaccctttgtctgcaa

SEQ ID NO: 54085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagaccctttgtctgcaat

SEQ ID NO: 54086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaaaaaaattataatcta

SEQ ID NO: 54087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctacagctccccactatgta

SEQ ID NO: 54088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaataacctgtcatgtctt

SEQ ID NO: 54089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcatgtctttggtctgtca

SEQ ID NO: 54090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtctttggtctgtcatag

SEQ ID NO: 54091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtctttggtctgtcataga

SEQ ID NO: 54092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttactaacctgatgctga

SEQ ID NO: 54093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttctgtttccctatttg

SEQ ID NO: 54094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctatttgcagtctacattc

SEQ ID NO: 54095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctacgtttaatttcccca

SEQ ID NO: 54096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctacgtttaatttccccaa

SEQ ID NO: 54097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgtttaatttccccaaaggt

SEQ ID NO: 54098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatttccccaaaggtcagc

SEQ ID NO: 54099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatgttccctttatctgaa

SEQ ID NO: 54100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attacttgctttgtaatatt

SEQ ID NO: 54101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaatacctcttgtatgaa

SEQ ID NO: 54102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataaattcaacccttcat

SEQ ID NO: 54103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctctttctcccatatctc

SEQ ID NO: 54104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccatatctccagtctgcttt

SEQ ID NO: 54105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccagtctgctttgagctgc

SEQ ID NO: 54106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtctgctttgagctgccag

SEQ ID NO: 54107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgccagcagtcccctaaatg

SEQ ID NO: 54108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggatttttatcctacttcta

SEQ ID NO: 54109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacgcctgtctccttcaac

SEQ ID NO: 54110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caactagattccaaacttca

SEQ ID NO: 54111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagattccaaacttcataga

SEQ ID NO: 54112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agattccaaacttcatagac

SEQ ID NO: 54113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catagacaggaaatttgtct

SEQ ID NO: 54114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atagacaggaaatttgtctt

SEQ ID NO: 54115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttaggcatgtattatcacc

SEQ ID NO: 54116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaggcatgtattatcacca

SEQ ID NO: 54117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaaggtataacatgatatc

SEQ ID NO: 54118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttaaatgcttgatgaatg

SEQ ID NO: 54119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatgcttgatgaatgaaga

SEQ ID NO: 54120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaatacttctcctaaccc

SEQ ID NO: 54121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcctaacccaagcacttg

SEQ ID NO: 54122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctaacccaagcacttgaag

SEQ ID NO: 54123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattatattgcctttaaca

SEQ ID NO: 54124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catagatgtcacactaattt

SEQ ID NO: 54125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatttaacaaaattttct

SEQ ID NO: 54126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaattttctaagattttt

SEQ ID NO: 54127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaagatttttcagtgttcc

SEQ ID NO: 54128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatttttcagtgttccaa

SEQ ID NO: 54129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactatcattgattttacat

SEQ ID NO: 54130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaacgctatctttaattta

SEQ ID NO: 54131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaaaacattgaaaaaca

SEQ ID NO: 54132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagcaatttccatcctttta

SEQ ID NO: 54133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaatttccatccttttatg

SEQ ID NO: 54134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatttccatccttttatgg

SEQ ID NO: 54135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgatatgtgcaaaaaatat

SEQ ID NO: 54136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatatgtgcaaaaaatata

SEQ ID NO: 54137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaacctgtttccccattt

SEQ ID NO: 54138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaacaacactatctgct

SEQ ID NO: 54139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaacaacactatctgctt

SEQ ID NO: 54140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctgcttaggtttaatta

SEQ ID NO: 54141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgcttaggtttaattaaag

SEQ ID NO: 54142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagtagctttttttttccc

SEQ ID NO: 54143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttttccccagccataaa

SEQ ID NO: 54144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttttccccagccataaac

SEQ ID NO: 54145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttccccagccataaacagg

SEQ ID NO: 54146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttccccagccataaacagga

SEQ ID NO: 54147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccataaacaggaaggttaa

SEQ ID NO: 54148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacaggaaggttaaaagtt

SEQ ID NO: 54149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaaggttaaaagtttggt

SEQ ID NO: 54150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggttaaaagtttggtcaga

SEQ ID NO: 54151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtttggtcagatggatgaa

SEQ ID NO: 54152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttggtcagatggatgaaa

SEQ ID NO: 54153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttggtcagatggatgaaaa

SEQ ID NO: 54154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttggtcagatggatgaaaag

SEQ ID NO: 54155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggtcagatggatgaaaagg

SEQ ID NO: 54156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggatgaaaagggggacaata

SEQ ID NO: 54157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaaagggggacaatatgg

SEQ ID NO: 54158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatggtggacaccaacta

SEQ ID NO: 54159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtttaaaattctctaatt

SEQ ID NO: 54160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtttaaaattctctaattt

SEQ ID NO: 54161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgggattacacaaatccca

SEQ ID NO: 54162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacaaatcccaaagttttt

SEQ ID NO: 54163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcccaaagtttttaagttca

SEQ ID NO: 54164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaagtttttaagttcacag

SEQ ID NO: 54165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcagaacttaaaaatacat

SEQ ID NO: 54166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagaacttaaaaatacatt

SEQ ID NO: 54167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacattttgacatgttcac

SEQ ID NO: 54168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacatgttcaccagtactt

SEQ ID NO: 54169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttaagcaccttaaaattg

SEQ ID NO: 54170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttatttgaaacatatattt

SEQ ID NO: 54171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatttgaaacatatattta

SEQ ID NO: 54172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatctttgaacatccaaca

SEQ ID NO: 54173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacatccaacaaagcgatc

SEQ ID NO: 54174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatcaagtatttaattgttt

SEQ ID NO: 54175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttaattgttttagaaacc

SEQ ID NO: 54176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaattgttttagaaacct

SEQ ID NO: 54177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgttttagaaacctaggca

SEQ ID NO: 54178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctaggcacagatacaatcc

SEQ ID NO: 54179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcacagatacaatcctaga

SEQ ID NO: 54180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttaatttttgccattaaaa

SEQ ID NO: 54181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgccattaaaatagtttatg

SEQ ID NO: 54182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatagtttatgcagtttg

SEQ ID NO: 54183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaagcttgtacgcaaataa

SEQ ID NO: 54184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagcttgtacgcaaataac

SEQ ID NO: 54185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagcttgtacgcaaataaca

SEQ ID NO: 54186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcttgtacgcaaataacagg

SEQ ID NO: 54187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtacgcaaataacagggag

SEQ ID NO: 54188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagggagaagctatactgaa

SEQ ID NO: 54189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttcatttccattaaatcc

SEQ ID NO: 54190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccaagacacatttatttg

SEQ ID NO: 54191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagacacatttatttgcaga

SEQ ID NO: 54192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttgcacatgtgactaatt

SEQ ID NO: 54193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttgcacatgtgactaattt

SEQ ID NO: 54194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcacatgtgactaatttg

SEQ ID NO: 54195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaatttggggttattaata

SEQ ID NO: 54196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatggttgaatataaata

SEQ ID NO: 54197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatatagcaaattttcat

SEQ ID NO: 54198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatatagcaaattttcatt

SEQ ID NO: 54199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatagcaaattttcattgg

SEQ ID NO: 54200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttcattgggagaaaatt

SEQ ID NO: 54201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaatttagaaaactgaa

SEQ ID NO: 54202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttagaaaactgaaaagca

SEQ ID NO: 54203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgaaattaacctattcc

SEQ ID NO: 54204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attactgattttttttttta

SEQ ID NO: 54205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactgatttttttttttaaa

SEQ ID NO: 54206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatgtctcctactgttacc

SEQ ID NO: 54207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgtctcctactgttaccc

SEQ ID NO: 54208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcctactgttacccaggctg

SEQ ID NO: 54209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccaggctgtggtgcaatca

SEQ ID NO: 54210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgcaacctccaaacctca

SEQ ID NO: 54211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgcaacctccaaacctcat

SEQ ID NO: 54212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctccaaacctcatgggctc

SEQ ID NO: 54213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaagtgttcttcccacct

SEQ ID NO: 54214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttcccacctcagcctccc

SEQ ID NO: 54215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccacctcagcctcccaag

SEQ ID NO: 54216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctcagcctcccaagtagc

SEQ ID NO: 54217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctcagcctcccaagtagct

SEQ ID NO: 54218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaagtagctaggacta

SEQ ID NO: 54219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaagtagctaggactac

SEQ ID NO: 54220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggtgtgcaccactatgtc

SEQ ID NO: 54221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggctaatttttttttttaa

SEQ ID NO: 54222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctaatttttttttttaatg

SEQ ID NO: 54223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggagtctctctctgtcacc

SEQ ID NO: 54224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagtctctctctgtcaccc

SEQ ID NO: 54225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctctctctgtcacccaggc

SEQ ID NO: 54226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctctctgtcacccaggctg

SEQ ID NO: 54227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtcacccaggctggagtg

SEQ ID NO: 54228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggagtgcagtgatatgatct

SEQ ID NO: 54229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactgcaacctctgcctct

SEQ ID NO: 54230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcaacctctgcctcttgg

SEQ ID NO: 54231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctctgcctcttggcagcac

SEQ ID NO: 54232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctgcctcttggcagcact

SEQ ID NO: 54233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttggcagcactgggataa

SEQ ID NO: 54234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttggcagcactgggataac

SEQ ID NO: 54235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcactgggataacaggcat

SEQ ID NO: 54236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatactgacaaaatgtttc

SEQ ID NO: 54237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgacaaaatgtttccaga

SEQ ID NO: 54238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgacaaaatgtttccagaa

SEQ ID NO: 54239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaaaatgtatatcatttt

SEQ ID NO: 54240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcatttttagcaacatgt

SEQ ID NO: 54241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatattttcccacaatgtt

SEQ ID NO: 54242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttcccacaatgttaagta

SEQ ID NO: 54243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaatttcgtgaaacatttc

SEQ ID NO: 54244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacatttctagttcttctt

SEQ ID NO: 54245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttctagttcttctttggt

SEQ ID NO: 54246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttctttggtcagtgtctt

SEQ ID NO: 54247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattattttcttgtttgcc

SEQ ID NO: 54248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattattttcttgtttgcca

SEQ ID NO: 54249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attattttcttgtttgccaa

SEQ ID NO: 54250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagggattgtgtgtgtgtg

SEQ ID NO: 54251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagggattgtgtgtgtgtgt

SEQ ID NO: 54252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggtgtgtgtgcacacgct

SEQ ID NO: 54253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggtgtgtgtgcacacgcta

SEQ ID NO: 54254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcttttttttttcttttgc

SEQ ID NO: 54255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactttgtctttactaaaac

SEQ ID NO: 54256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactggttttcaaaaatgaa

SEQ ID NO: 54257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatatataattactcttta

SEQ ID NO: 54258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatatataattactctttaa

SEQ ID NO: 54259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactctttaaaggaattatg

SEQ ID NO: 54260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcatatatatgttttcccat

SEQ ID NO: 54261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catatatatgttttcccatt

SEQ ID NO: 54262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatatgttttcccattgg

SEQ ID NO: 54263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatatgttttcccattggg

SEQ ID NO: 54264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatatgttttcccattggga

SEQ ID NO: 54265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgttttcccattgggaggg

SEQ ID NO: 54266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttattttcatgacatatttc

SEQ ID NO: 54267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattttcatgacatatttct

SEQ ID NO: 54268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacatatttctgggaaaca

SEQ ID NO: 54269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacatatttctgggaaacat

SEQ ID NO: 54270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttctgggaaacataggcc

SEQ ID NO: 54271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaacataggcctagaaat

SEQ ID NO: 54272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatttttttttttttttga

SEQ ID NO: 54273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttttttttgacagattct

SEQ ID NO: 54274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgacagattctcagtc

SEQ ID NO: 54275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgacagattctcagtctg

SEQ ID NO: 54276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagattctcagtctggagtg

SEQ ID NO: 54277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attctcagtctggagtgcag

SEQ ID NO: 54278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagtgcagtggcatgatct

SEQ ID NO: 54279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactataacctctgcctcc

SEQ ID NO: 54280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgcctcctggattc

SEQ ID NO: 54281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagtgattctcctgcct

SEQ ID NO: 54282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctcct

SEQ ID NO: 54283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgcctcagcctcctgag

SEQ ID NO: 54284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcctgagtagc

SEQ ID NO: 54285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcctgagtagct

SEQ ID NO: 54286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcctgagtagctgggacta

SEQ ID NO: 54287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctgagtagctgggactat

SEQ ID NO: 54288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggtgcctgccaccacgcc

SEQ ID NO: 54289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagctaatttttgtatttt

SEQ ID NO: 54290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctaatttttgtatttttag

SEQ ID NO: 54291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgtatttttagtagcga

SEQ ID NO: 54292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtatttttagtagcgac

SEQ ID NO: 54293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtatttttagtagcgaca

SEQ ID NO: 54294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcgacagggtttcaccatgt

SEQ ID NO: 54295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagggtttcaccatgttggc

SEQ ID NO: 54296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggtttcaccatgttggcc

SEQ ID NO: 54297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccatgttggccagga

SEQ ID NO: 54298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accttgtgatctgcccgcct

SEQ ID NO: 54299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccttggcctcccaaaatgc

SEQ ID NO: 54300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttggcctcccaaaatgct

SEQ ID NO: 54301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaaatgctgggatta

SEQ ID NO: 54302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaaatgctgggattac

SEQ ID NO: 54303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgctgggattacaggcgt

SEQ ID NO: 54304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggcgtgagccactgcgcc

SEQ ID NO: 54305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccactgcgcctggccaaaat

SEQ ID NO: 54306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgcgcctggccaaaatg

SEQ ID NO: 54307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaaaatgaggtttttcaca

SEQ ID NO: 54308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaggtttttcacacagtccc

SEQ ID NO: 54309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtttttcacacagtccctg

SEQ ID NO: 54310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtccctggagtcttgtct

SEQ ID NO: 54311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtccctggagtcttgtctg

SEQ ID NO: 54312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctggagtcttgtctgaggc

SEQ ID NO: 54313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggagtcttgtctgaggct

SEQ ID NO: 54314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtcttgtctgaggctgggt

SEQ ID NO: 54315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcttgtctgaggctgggtg

SEQ ID NO: 54316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaactgaactatcctgct

SEQ ID NO: 54317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgcctcttttcttttct

SEQ ID NO: 54318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttttcttttctcagtgtt

SEQ ID NO: 54319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttttcttttctcagtgttt

SEQ ID NO: 54320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttgggtcatccacctcct

SEQ ID NO: 54321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgggtcatccacctcctca

SEQ ID NO: 54322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtacaacatttttttatt

SEQ ID NO: 54323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttagatttttgtataacg

SEQ ID NO: 54324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataacgaagtttctttaatg

SEQ ID NO: 54325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctacatttttacacacataa

SEQ ID NO: 54326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcattcattcattcattc

SEQ ID NO: 54327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcattcattcaagttcattc

SEQ ID NO: 54328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttcattccagacatattt

SEQ ID NO: 54329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcattccagacatatttta

SEQ ID NO: 54330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcattccagacatattttag

SEQ ID NO: 54331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattatttgattatcatcct

SEQ ID NO: 54332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgattatcatcctaagcat

SEQ ID NO: 54333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattatcatcctaagcatca

SEQ ID NO: 54334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatcatcctaagcatcagag

SEQ ID NO: 54335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcctaagcatcagagcagt

SEQ ID NO: 54336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagagcagttagtaactcc

SEQ ID NO: 54337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagttagtaactccaagaa

SEQ ID NO: 54338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaagaacagaacattttt

SEQ ID NO: 54339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaacatttttaagttgaa

SEQ ID NO: 54340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatttttaagttgaaaagt

SEQ ID NO: 54341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catttttaagttgaaaagtt

SEQ ID NO: 54342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaagttaggtccaaattg

SEQ ID NO: 54343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaagttaggtccaaattgc

SEQ ID NO: 54344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccattttttccccataaa

SEQ ID NO: 54345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattcttatatttatttttg

SEQ ID NO: 54346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatttttgaagaataaatt

SEQ ID NO: 54347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttagccacaaaactcaa

SEQ ID NO: 54348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcactcttcaatgtttcc

SEQ ID NO: 54349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatccaaattcctcccctg

SEQ ID NO: 54350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctcccctgtggacaacca

SEQ ID NO: 54351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccttgtgtatccatccatg

SEQ ID NO: 54352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccatccatgtggttttat

SEQ ID NO: 54353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttccttcgtcacttaaaaat

SEQ ID NO: 54354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtcacttaaaaatcagact

SEQ ID NO: 54355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttggaaatctttctgtat

SEQ ID NO: 54356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctgtatcagcatgtata

SEQ ID NO: 54357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataaagctacttcttttta

SEQ ID NO: 54358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagctacttctttttatag

SEQ ID NO: 54359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttttatagcagcttcata

SEQ ID NO: 54360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttcataaagtcctattgta

SEQ ID NO: 54361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagctgtacccaaattatt

SEQ ID NO: 54362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttagtcattcccacactg

SEQ ID NO: 54363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcccacactgtagaacatt

SEQ ID NO: 54364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccacactgtagaacattt

SEQ ID NO: 54365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatttaggttgtttccca

SEQ ID NO: 54366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaataattatcttctcat

SEQ ID NO: 54367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttttaacctactcttttg

SEQ ID NO: 54368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttttaacctactcttttgt

SEQ ID NO: 54369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttttgtaacttttatttt

SEQ ID NO: 54370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtaacttttattttaagtt

SEQ ID NO: 54371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaacttttattttaagttc

SEQ ID NO: 54372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taacttttattttaagttca

SEQ ID NO: 54373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacttttattttaagttcag

SEQ ID NO: 54374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagttcaggggtacatgca

SEQ ID NO: 54375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagttcaggggtacatgcac

SEQ ID NO: 54376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatgcacaggtttgttaca

SEQ ID NO: 54377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgcacaggtttgttacac

SEQ ID NO: 54378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgcacaggtttgttacaca

SEQ ID NO: 54379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacagggaaacttgtgtta

SEQ ID NO: 54380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacagggaaacttgtgttac

SEQ ID NO: 54381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acagggaaacttgtgttaca

SEQ ID NO: 54382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacatcttatttcatcacc

SEQ ID NO: 54383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacatcttatttcatcacca

SEQ ID NO: 54384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttcatcaccaaggtctt

SEQ ID NO: 54385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaccaaggtcttaagcc

SEQ ID NO: 54386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcttaagccaagtacttat

SEQ ID NO: 54387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgccaccctccaccctccaa

SEQ ID NO: 54388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccaccctccaccctccaat

SEQ ID NO: 54389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccaccctccaatgggccc

SEQ ID NO: 54390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtccatgtgttctcatcatt

SEQ ID NO: 54391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcatttagctctcacttat

SEQ ID NO: 54392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagctctcacttataagt

SEQ ID NO: 54393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagctctcacttataagtg

SEQ ID NO: 54394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgaggacattctcttgaa

SEQ ID NO: 54395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cattctcttgaatagtttca

SEQ ID NO: 54396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcttgaatagtttcacagta

SEQ ID NO: 54397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtacggtattttatttgt

SEQ ID NO: 54398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttgtaagacaaatgctt

SEQ ID NO: 54399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgtaagacaaatgcttca

SEQ ID NO: 54400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcttcagagtgaaattgct

SEQ ID NO: 54401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccgaattctcttttgttacc

SEQ ID NO: 54402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttacctagtgtaacgccta

SEQ ID NO: 54403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttacctagtgtaacgcctac

SEQ ID NO: 54404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacctagtgtaacgcctaca

SEQ ID NO: 54405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtaacgcctacagggcca

SEQ ID NO: 54406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctaactctgctgatcttt

SEQ ID NO: 54407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgctgatctttaagaaa

SEQ ID NO: 54408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctgctgatctttaagaaac

SEQ ID NO: 54409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaatgttccatttgtaac

SEQ ID NO: 54410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatgttccatttgtaacca

SEQ ID NO: 54411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttccatttgtaaccagag

SEQ ID NO: 54412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catttgtaaccagagcagct

SEQ ID NO: 54413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagagcagctgagattgct

SEQ ID NO: 54414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agctgagattgcttagaacc

SEQ ID NO: 54415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagattgcttagaaccaaga

SEQ ID NO: 54416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaccaagatagttgacta

SEQ ID NO: 54417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaccaagatagttgactaa

SEQ ID NO: 54418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagttgactaaaggacttc

SEQ ID NO: 54419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgactaaaggacttcaag

SEQ ID NO: 54420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaggacttcaagaagacct

SEQ ID NO: 54421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggacttcaagaagacctc

SEQ ID NO: 54422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgctaaatgacacccccac

SEQ ID NO: 54423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacccccaccagtgccatga

SEQ ID NO: 54424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataatccccatgacaatgac

SEQ ID NO: 54425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccccatgacaatgaccag

SEQ ID NO: 54426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccatgacaatgaccagaag

SEQ ID NO: 54427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaccagaagaagccataa

SEQ ID NO: 54428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaccagaagaagccataaa

SEQ ID NO: 54429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagccataaaaggacaaa

SEQ ID NO: 54430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagccataaaaggacaaaa

SEQ ID NO: 54431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccataaaaggacaaaaagg

SEQ ID NO: 54432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccataaaaggacaaaaagga

SEQ ID NO: 54433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaaaggacaaaaaggaagg

SEQ ID NO: 54434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaaggaaggcggcactc

SEQ ID NO: 54435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaggcggcactctggttcc

SEQ ID NO: 54436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcggcactctggttccaag

SEQ ID NO: 54437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaagttcaccacctatttc

SEQ ID NO: 54438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaccacctatttctggaa

SEQ ID NO: 54439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaatgaccaacttcttcat

SEQ ID NO: 54440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaatttcctcactcctcac

SEQ ID NO: 54441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcctcactcctcactagtc

SEQ ID NO: 54442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcactcctcactagtcaag

SEQ ID NO: 54443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcctcactagtcaagaagt

SEQ ID NO: 54444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttgcacttctccattctt

SEQ ID NO: 54445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctttggccatcgaata

SEQ ID NO: 54446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cactttcccatttcttgtat

SEQ ID NO: 54447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actttcccatttcttgtatt

SEQ ID NO: 54448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgggtctccaataccaaa

SEQ ID NO: 54449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgggtctccaataccaaac

SEQ ID NO: 54450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggtctccaataccaaaca

SEQ ID NO: 54451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctccaataccaaacaggga

SEQ ID NO: 54452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccaccttttgaaactacc

SEQ ID NO: 54453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccaccttttgaaactacca

SEQ ID NO: 54454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caccttttgaaactaccaag

SEQ ID NO: 54455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accttttgaaactaccaagg

SEQ ID NO: 54456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaactaccaaggaggttat

SEQ ID NO: 54457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaggaggttattggtatat

SEQ ID NO: 54458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattggtaactccttcata

SEQ ID NO: 54459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattggtaactccttcataa

SEQ ID NO: 54460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctctccccaaacaatgtgt

SEQ ID NO: 54461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctccccaaacaatgtgtc

SEQ ID NO: 54462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctccccaaacaatgtgtca

SEQ ID NO: 54463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttgcacataccttcaata

SEQ ID NO: 54464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaattttttttcatctttgt

SEQ ID NO: 54465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcatctttgtgagcctaat

SEQ ID NO: 54466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctttgtgagcctaataag

SEQ ID NO: 54467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctttgtgagcctaataagt

SEQ ID NO: 54468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttgtgagcctaataagtg

SEQ ID NO: 54469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatttatttatttatttt

SEQ ID NO: 54470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatttatttattttgaga

SEQ ID NO: 54471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatttatttattttgagatg

SEQ ID NO: 54472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagtcgctctctcattgcc

SEQ ID NO: 54473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagtcgctctctcattgccc

SEQ ID NO: 54474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgctctctcattgcccaggc

SEQ ID NO: 54475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctctctcattgcccaggctg

SEQ ID NO: 54476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgcccaggctggagtgcct

SEQ ID NO: 54477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagtgccttggtgcgatct

SEQ ID NO: 54478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactgcaacatctgcctcc

SEQ ID NO: 54479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcaacatctgcctcct

SEQ ID NO: 54480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatctgcctcctgggttc

SEQ ID NO: 54481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctgcctcctgggttcaag

SEQ ID NO: 54482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagcagttctcctgcct

SEQ ID NO: 54483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctcct

SEQ ID NO: 54484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgcctcagcctcctgag

SEQ ID NO: 54485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cctcagcctcctgagtagct

SEQ ID NO: 54486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctcctgagtagctcggat

SEQ ID NO: 54487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcctgagtagctcggatta

SEQ ID NO: 54488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctgagtagctcggattag

SEQ ID NO: 54489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaggtacccaccaccacacc

SEQ ID NO: 54490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccggctaatttttgtacctt

SEQ ID NO: 54491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctaatttttgtacctttag

SEQ ID NO: 54492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatttttgtacctttagta

SEQ ID NO: 54493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgtacctttagtagaga

SEQ ID NO: 54494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtacctttagtagagac

SEQ ID NO: 54495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacaggttttcaccatgt

SEQ ID NO: 54496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggttttcaccatgttggc

SEQ ID NO: 54497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggttttcaccatgttggcc

SEQ ID NO: 54498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccatgttggccaggc

SEQ ID NO: 54499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcatgtgatccacccatct

SEQ ID NO: 54500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacccatctcagcttccca

SEQ ID NO: 54501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctcagcttcccaaagtgc

SEQ ID NO: 54502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcagcttcccaaagtgct

SEQ ID NO: 54503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgggatcacaaacat

SEQ ID NO: 54504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caaacatgagccaccacacc

SEQ ID NO: 54505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttcttaattcttatcattt

SEQ ID NO: 54506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtttgcattttcttttgt

SEQ ID NO: 54507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcattttcttttgtgagt

SEQ ID NO: 54508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcattttcttttgtgagtg

SEQ ID NO: 54509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttcttttgtgagtgaggt

SEQ ID NO: 54510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcttttgtgagtgaggtc

SEQ ID NO: 54511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcttttgtgagtgaggtca

SEQ ID NO: 54512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagggatcttttcatatcct

SEQ ID NO: 54513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgtgctctgtctgtatg

SEQ ID NO: 54514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtcttgtccacttttttaa

SEQ ID NO: 54515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccacttttttaatagactat

SEQ ID NO: 54516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctatcagtgttttattaatt

SEQ ID NO: 54517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcagtgttttattaattt

SEQ ID NO: 54518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttaacaaaataataaaat

SEQ ID NO: 54519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaattagctttttttctg

SEQ ID NO: 54520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaatacaaatatttttgt

SEQ ID NO: 54521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgctgtttttgtttcttt

SEQ ID NO: 54522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgtttcttttggttta

SEQ ID NO: 54523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtttcttttggtttatgg

SEQ ID NO: 54524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatggtagtttatcttttaa

SEQ ID NO: 54525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaattcaccaatcctttctc

SEQ ID NO: 54526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcaccaatcctttctccag

SEQ ID NO: 54527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgtgttttatattatct

SEQ ID NO: 54528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaaaataatttctacttc

SEQ ID NO: 54529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctacttcaagtacttcat

SEQ ID NO: 54530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacttcataagtgtgatgac

SEQ ID NO: 54531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acttcataagtgtgatgact

SEQ ID NO: 54532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggttttcacatgcatatgt

SEQ ID NO: 54533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cattgatatattatccatct

SEQ ID NO: 54534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgatatattatccatctc

SEQ ID NO: 54535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattatccatctcaggtgaa

SEQ ID NO: 54536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catctcaggtgaaaagaaaa

SEQ ID NO: 54537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaccttcacatgttttcttc

SEQ ID NO: 54538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttcacatgttttcttctag

SEQ ID NO: 54539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttttcttctagcagttttg

SEQ ID NO: 54540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattccactaaaatgtatct

SEQ ID NO: 54541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attccactaaaatgtatctt

SEQ ID NO: 54542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactaaaatgtatcttgggt

SEQ ID NO: 54543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaaaatgtatcttgggtt

SEQ ID NO: 54544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatgtatcttgggttagg

SEQ ID NO: 54545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatcttgggttaggtggca

SEQ ID NO: 54546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttgggttaggtggcaaag

SEQ ID NO: 54547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttatccacatgactacc

SEQ ID NO: 54548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttatccacatgactaccc

SEQ ID NO: 54549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatttctttcaacctattt

SEQ ID NO: 54550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgtaactatgtctatttc

SEQ ID NO: 54551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttccaatgaactatctatg

SEQ ID NO: 54552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttccaatgaactatctatgt

SEQ ID NO: 54553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cataaaataacattatgtat

SEQ ID NO: 54554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaaataacattatgtatt

SEQ ID NO: 54555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaataacattatgtatta

SEQ ID NO: 54556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataacattatgtattagggt

SEQ ID NO: 54557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtattagggttggtgctat

SEQ ID NO: 54558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgtgtacaatttcccaac

SEQ ID NO: 54559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacaatttcccaactagatc

SEQ ID NO: 54560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagattatctaattccaaa

SEQ ID NO: 54561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagattatctaattccaaat

SEQ ID NO: 54562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttctatttttattttcat

SEQ ID NO: 54563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttctatttttattttcatt

SEQ ID NO: 54564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaatgtctttataaattaa

SEQ ID NO: 54565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatgtctttataaattaaa

SEQ ID NO: 54566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttataaattaaaaggttaa

SEQ ID NO: 54567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttataaattaaaaggttaaa

SEQ ID NO: 54568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggttaaaaggaactgccaa

SEQ ID NO: 54569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaggaactgccaatggt

SEQ ID NO: 54570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttttaatacctcttctt

SEQ ID NO: 54571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctttagattataaaaaca

SEQ ID NO: 54572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttataaaaacaaagtatgcc

SEQ ID NO: 54573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgccaagtataatatcac

SEQ ID NO: 54574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtataatatcacaagaaaaa

SEQ ID NO: 54575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataatatcacaagaaaaac

SEQ ID NO: 54576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatatcacaagaaaaacagg

SEQ ID NO: 54577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatcacaagaaaaacaggc

SEQ ID NO: 54578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaagaaaaacaggcaggc

SEQ ID NO: 54579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcaggctggctactcattt

SEQ ID NO: 54580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttagaacctctaatgtt

SEQ ID NO: 54581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttaccattgcatccttcat

SEQ ID NO: 54582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaataattattatttct

SEQ ID NO: 54583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcttagaaatgcttaatt

SEQ ID NO: 54584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttagaaatgcttaatttgg

SEQ ID NO: 54585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaatgcttaatttggtaga

SEQ ID NO: 54586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatttggtagatggcaaat

SEQ ID NO: 54587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcagtttaataacttcaac

SEQ ID NO: 54588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtttaataacttcaacaa

SEQ ID NO: 54589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaataacttcaacaagag

SEQ ID NO: 54590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctaaaatcattcaatttta

SEQ ID NO: 54591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcaattttatggcatttta

SEQ ID NO: 54592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattttatggcattttatag

SEQ ID NO: 54593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttatagtagttgaacaac

SEQ ID NO: 54594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actggtatgcaaaacaaatt

SEQ ID NO: 54595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatgcgataattttatatt

SEQ ID NO: 54596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttatattcagacaactga

SEQ ID NO: 54597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatattcagacaactgat

SEQ ID NO: 54598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatattcagacaactgata

SEQ ID NO: 54599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attattaaaatattgtgatt

SEQ ID NO: 54600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttattaaaatattgtgattt

SEQ ID NO: 54601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatttattattttattatt

SEQ ID NO: 54602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattattttattattaaga

SEQ ID NO: 54603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattttattattaagatag

SEQ ID NO: 54604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttattattaagatagaagt

SEQ ID NO: 54605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagaagttagtcttatgta

SEQ ID NO: 54606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtatagccttttaaaata

SEQ ID NO: 54607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaaatatagtattcctc

SEQ ID NO: 54608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagtattcctcaagtttat

SEQ ID NO: 54609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaagtttataagaaatga

SEQ ID NO: 54610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tataagaaatgaaagtttgc

SEQ ID NO: 54611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataagaaatgaaagtttgcc

SEQ ID NO: 54612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatgaaagtttgccgggcg

SEQ ID NO: 54613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaagtttgccgggcgtgg

SEQ ID NO: 54614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctataatcc

SEQ ID NO: 54615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctataatcccagcactt

SEQ ID NO: 54616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctataatcccagcacttt

SEQ ID NO: 54617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataatcccagcactttggg

SEQ ID NO: 54618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcactttgggaagcc

SEQ ID NO: 54619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttgggaagccg

SEQ ID NO: 54620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcactttgggaagccgagg

SEQ ID NO: 54621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcactttgggaagccgaggc

SEQ ID NO: 54622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctttgggaagccgaggcagg

SEQ ID NO: 54623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgaggcaggcggatcacct

SEQ ID NO: 54624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgaggcaggcggatcacctg

SEQ ID NO: 54625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggcggatcacctgaggt

SEQ ID NO: 54626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggcggatcacctgaggtc

SEQ ID NO: 54627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacctgaggtcaggaattc

SEQ ID NO: 54628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaggtcaggaattcaagac

SEQ ID NO: 54629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagaccagcctgaccaaca

SEQ ID NO: 54630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaccagcctgaccaacatg

SEQ ID NO: 54631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctactaaaaatacaaaat

SEQ ID NO: 54632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actaaaaatacaaaattagc

SEQ ID NO: 54633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatacaaaattagctggtca

SEQ ID NO: 54634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattagctggtcatgg

SEQ ID NO: 54635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcgcatgcctgtaatcc

SEQ ID NO: 54636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcctgtaatcccagctact

SEQ ID NO: 54637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcctgtaatcccagctactc

SEQ ID NO: 54638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccagctactcag

SEQ ID NO: 54639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagctactcagg

SEQ ID NO: 54640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctactcaggaggct

SEQ ID NO: 54641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctactcaggaggctg

SEQ ID NO: 54642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctactcaggaggctgagg

SEQ ID NO: 54643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctactcaggaggctgaggc

SEQ ID NO: 54644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactcaggaggctgaggcag

SEQ ID NO: 54645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcaggagaactgcttgaacc

SEQ ID NO: 54646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagaactgcttgaaccc

SEQ ID NO: 54647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaactgcttgaacccgg

SEQ ID NO: 54648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaactgcttgaacccggg

SEQ ID NO: 54649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactgcttgaacccgggagg

SEQ ID NO: 54650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaacccgggaggtggattg

SEQ ID NO: 54651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccgggaggtggattgtagt

SEQ ID NO: 54652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaggtggattgtagtgagct

SEQ ID NO: 54653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggattgtagtgagctgagat

SEQ ID NO: 54654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gattgtagtgagctgagatc

SEQ ID NO: 54655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatcgggccattgcactc

SEQ ID NO: 54656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgggccattgcactccagcc

SEQ ID NO: 54657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggccattgcactccagcct

SEQ ID NO: 54658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcactccagcctgggcaac

SEQ ID NO: 54659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactccagcctgggcaacaa

SEQ ID NO: 54660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtctcaaaaaaaaaaaaaa

SEQ ID NO: 54661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaagaaaaaaaaaaa

SEQ ID NO: 54662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaagaaatta

SEQ ID NO: 54663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattaaagtttataatctt

SEQ ID NO: 54664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaagtttataatcttaag

SEQ ID NO: 54665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttaagaagtgtattaccc

SEQ ID NO: 54666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttaagaagtgtattaccct

SEQ ID NO: 54667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtattaccctgggaaaactt

SEQ ID NO: 54668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accctgggaaaacttaagat

SEQ ID NO: 54669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agattagtgtcaacatttgc

SEQ ID NO: 54670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttttaataaaaaattcata

SEQ ID NO: 54671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcataaagtcttatctgta

SEQ ID NO: 54672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatctgtacagcatgtata

SEQ ID NO: 54673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatctgtacagcatgtataa

SEQ ID NO: 54674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtacagcatgtataaagg

SEQ ID NO: 54675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcatgtataaaggaaga

SEQ ID NO: 54676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaagacagaaaatacttct

SEQ ID NO: 54677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaaatcccatctctctgt

SEQ ID NO: 54678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcccatctctctgttagtt

SEQ ID NO: 54679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttagttaagactttatt

SEQ ID NO: 54680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttagttaagactttattga

SEQ ID NO: 54681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgagagcacaaaattatca

SEQ ID NO: 54682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattatcacagactta

SEQ ID NO: 54683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatcacagacttatggctg

SEQ ID NO: 54684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagacttatggctgcagaa

SEQ ID NO: 54685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagacttatggctgcagaac

SEQ ID NO: 54686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatacccttatttaaataat

SEQ ID NO: 54687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacccttatttaaataatta

SEQ ID NO: 54688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccttatttaaataattaga

SEQ ID NO: 54689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcaaaacatcaacatgatt

SEQ ID NO: 54690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaaacatcaacatgattt

SEQ ID NO: 54691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaacatcaacatgatttag

SEQ ID NO: 54692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaacatgatttaggaga

SEQ ID NO: 54693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatttaggagaaagtgca

SEQ ID NO: 54694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagtgcatagtaataactt

SEQ ID NO: 54695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catagtaataactttggcac

SEQ ID NO: 54696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atagtaataactttggcacc

SEQ ID NO: 54697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaataactttggcaccagg

SEQ ID NO: 54698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actttggcaccaggcagact

SEQ ID NO: 54699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttggcaccaggcagactt

SEQ ID NO: 54700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgtttattccatataat

SEQ ID NO: 54701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attccatataattagctctg

SEQ ID NO: 54702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaaattccccataaatga

SEQ ID NO: 54703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaattccccataaatgaaa

SEQ ID NO: 54704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattccccataaatgaaaga

SEQ ID NO: 54705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaatatatctgtcttata

SEQ ID NO: 54706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtcttataaagttatcatg

SEQ ID NO: 54707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataaagttatcatgtagaa

SEQ ID NO: 54708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttatcatgtagaatagaaa

SEQ ID NO: 54709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtagaatagaaatggttt

SEQ ID NO: 54710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatagaaatggttttggta

SEQ ID NO: 54711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttggtaaagtgcctacca

SEQ ID NO: 54712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtgcctaccacagtgcc

SEQ ID NO: 54713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtgcctaccacagtgcct

SEQ ID NO: 54714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcctaggctaaataaataa

SEQ ID NO: 54715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggctaaataaataacagc

SEQ ID NO: 54716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattatccttcttccctata

SEQ ID NO: 54717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactgaaatttttaaataat

SEQ ID NO: 54718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttttaaataataagccat

SEQ ID NO: 54719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaataataagccatgagt

SEQ ID NO: 54720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccttacgaaaatcttatg

SEQ ID NO: 54721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccttacgaaaatcttatgtg

SEQ ID NO: 54722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatcttgccaaacatgttta

SEQ ID NO: 54723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatggctttaatttaaaata

SEQ ID NO: 54724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatttaaaatatagatctg

SEQ ID NO: 54725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatagatctgcagtaaaa

SEQ ID NO: 54726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagatctgcagtaaaatagt

SEQ ID NO: 54727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgcagtaaaatagtaaga

SEQ ID NO: 54728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatagtaagacagcataacc

SEQ ID NO: 54729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacccagttgttaaattca

SEQ ID NO: 54730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttgttaaattcatggctc

SEQ ID NO: 54731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgttaaattcatggctcca

SEQ ID NO: 54732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaattcatggctccagagt

SEQ ID NO: 54733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattcatggctccagagtga

SEQ ID NO: 54734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcatggctccagagtgaga

SEQ ID NO: 54735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatggctccagagtgagag

SEQ ID NO: 54736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctccagagtgagagaggca

SEQ ID NO: 54737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctccagagtgagagaggcat

SEQ ID NO: 54738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcccatctctactgcttac

SEQ ID NO: 54739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcttactagcttatgtcct

SEQ ID NO: 54740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcttactagcttatgtcctt

SEQ ID NO: 54741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttactagcttatgtccttg

SEQ ID NO: 54742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatttaattaacttctcta

SEQ ID NO: 54743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taattaacttctctaaagct

SEQ ID NO: 54744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaaagctcagttcttata

SEQ ID NO: 54745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcagttcttatatagcaaac

SEQ ID NO: 54746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttcttatatagcaaaccg

SEQ ID NO: 54747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctgaaaatgataatccttt

SEQ ID NO: 54748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgaaaatgataatccttta

SEQ ID NO: 54749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataatcctttaaggttattt

SEQ ID NO: 54750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcctttaaggttattttag

SEQ ID NO: 54751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttattttagtggaaaaaat

SEQ ID NO: 54752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacactgaattttaataact

SEQ ID NO: 54753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacatttcctgttacacttt

SEQ ID NO: 54754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacattgtaactgttattat

SEQ ID NO: 54755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgttattattagtgattt

SEQ ID NO: 54756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattttagcaactttcttct

SEQ ID NO: 54757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttgattttgtataccta

SEQ ID NO: 54758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacctaaagctaatgttct

SEQ ID NO: 54759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacctaaagctaatgttctt

SEQ ID NO: 54760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagctaatgttcttaggaac

SEQ ID NO: 54761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatatttgcttactttataa

SEQ ID NO: 54762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcttactttataatagaa

SEQ ID NO: 54763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatacaaaaccttttcttct

SEQ ID NO: 54764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atacaaaaccttttcttctt

SEQ ID NO: 54765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacaaaaccttttcttctta

SEQ ID NO: 54766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaaaccttttcttcttagg

SEQ ID NO: 54767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcttagggagctttcaact

SEQ ID NO: 54768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcaactcagaatatttta

SEQ ID NO: 54769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagactaaaatgtatgctta

SEQ ID NO: 54770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatgcttatagcaaaacc

SEQ ID NO: 54771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actacattgccttctaccaa

SEQ ID NO: 54772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctacattgccttctaccaac

SEQ ID NO: 54773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattgccttctaccaacagg

SEQ ID NO: 54774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcaatatatgccacaca

SEQ ID NO: 54775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgccacacacagccattt

SEQ ID NO: 54776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttagtcctgccaataca

SEQ ID NO: 54777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgccaatacaaagttcat

SEQ ID NO: 54778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaagttcattagtttatt

SEQ ID NO: 54779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attagtttattcagtgtcta

SEQ ID NO: 54780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagtttattcagtgtctac

SEQ ID NO: 54781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattcagtgtctacaggatg

SEQ ID NO: 54782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attcagtgtctacaggatgt

SEQ ID NO: 54783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggatgtgggccttgctttc

SEQ ID NO: 54784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggatgtgggccttgctttca

SEQ ID NO: 54785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataaattcttaaatccat

SEQ ID NO: 54786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataaattcttaaatccatc

SEQ ID NO: 54787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccatcaggtttgataaatg

SEQ ID NO: 54788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtggatacactgaacacacc

SEQ ID NO: 54789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggatacactgaacacaccg

SEQ ID NO: 54790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacacaccgaggatgttga

SEQ ID NO: 54791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatttaataacaaaaacat

SEQ ID NO: 54792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaaacattggaatatca

SEQ ID NO: 54793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaaacattggaatatcat

SEQ ID NO: 54794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggaatatcatgggaacca

SEQ ID NO: 54795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaataataaaatgatcga

SEQ ID NO: 54796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataataaaatgatcgaaagt

SEQ ID NO: 54797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtaagaaaataataaatg

SEQ ID NO: 54798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaataataaatgtggc

SEQ ID NO: 54799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatgtggcaagtgcataa

SEQ ID NO: 54800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cataaaagtttaatcattga

SEQ ID NO: 54801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacagtaatgatgaccctc

SEQ ID NO: 54802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacagtaatgatgaccctct

SEQ ID NO: 54803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgatgaccctctaggact

SEQ ID NO: 54804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgaccctctaggactgag

SEQ ID NO: 54805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactgagcagaattatgcaa

SEQ ID NO: 54806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcaaaagtttaaaataat

SEQ ID NO: 54807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtttaaaataatgagct

SEQ ID NO: 54808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtttaaaataatgagctt

SEQ ID NO: 54809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaataatgagcttaggcaa

SEQ ID NO: 54810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatgagcttaggcaatagc

SEQ ID NO: 54811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagcttaggcaatagccagc

SEQ ID NO: 54812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaatagccagcaagatac

SEQ ID NO: 54813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaatagccagcaagataca

SEQ ID NO: 54814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaaaaatgaaaatgctc

SEQ ID NO: 54815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatgaaaatgctctagcat

SEQ ID NO: 54816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaatgctctagcatgagt

SEQ ID NO: 54817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatgctctagcatgagtca

SEQ ID NO: 54818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgctctagcatgagtcag

SEQ ID NO: 54819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagtcagaggatttttcat

SEQ ID NO: 54820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcagaggatttttcattag

SEQ ID NO: 54821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agaggatttttcattagcag

SEQ ID NO: 54822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcattagcagcggatgctc

SEQ ID NO: 54823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctccagaacttaatgcta

SEQ ID NO: 54824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagaacttaatgctaaagt

SEQ ID NO: 54825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttaatgctaaagtgagaa

SEQ ID NO: 54826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgctaaagtgagaaaagac

SEQ ID NO: 54827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgctaaagtgagaaaagact

SEQ ID NO: 54828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagactaggtattcattc

SEQ ID NO: 54829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agactaggtattcattcaag

SEQ ID NO: 54830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactaggtattcattcaaga

SEQ ID NO: 54831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattcaagaaggcaaaatcc

SEQ ID NO: 54832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaggcaaaatccaagca

SEQ ID NO: 54833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaaaatccaagcacagtaa

SEQ ID NO: 54834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgctgatgaaatattcctga

SEQ ID NO: 54835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctgatgaaatattcctgat

SEQ ID NO: 54836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgatgaaatattcctgatg

SEQ ID NO: 54837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaaatattcctgatgggg

SEQ ID NO: 54838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaatattcctgatggggc

SEQ ID NO: 54839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatggggcaggaattgttaa

SEQ ID NO: 54840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttaattcaatatcaaaat

SEQ ID NO: 54841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattcaatatcaaaataagt

SEQ ID NO: 54842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatcaaaataagtgagtt

SEQ ID NO: 54843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaaaataagtgagttaag

SEQ ID NO: 54844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttaagaagcatgcatgcca

SEQ ID NO: 54845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcatgccaaagtattctt

SEQ ID NO: 54846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtattctttggaacatttg

SEQ ID NO: 54847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtggacattgtcaaaac

SEQ ID NO: 54848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactagtgacatctactcat

SEQ ID NO: 54849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactcataagatttttgatg

SEQ ID NO: 54850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttgatgaagacattgttt

SEQ ID NO: 54851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattgtttgagaatctatat

SEQ ID NO: 54852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgagaatctatattagca

SEQ ID NO: 54853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgagaatctatattagcaa

SEQ ID NO: 54854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatctatattagcaaagg

SEQ ID NO: 54855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaatctatattagcaaagga

SEQ ID NO: 54856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatctatattagcaaaggaa

SEQ ID NO: 54857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atctatattagcaaaggaag

SEQ ID NO: 54858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctatattagcaaaggaagg

SEQ ID NO: 54859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaaaggaagggggtaatc

SEQ ID NO: 54860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaagggggtaatctggttt

SEQ ID NO: 54861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagggggtaatctggtttg

SEQ ID NO: 54862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggggtaatctggtttgag

SEQ ID NO: 54863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatctggtttgaggagtcta

SEQ ID NO: 54864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctggtttgaggagtctaa

SEQ ID NO: 54865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttgaggagtctaaaggaa

SEQ ID NO: 54866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtctaaaggaacagtttatt

SEQ ID NO: 54867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaggaacagtttatttag

SEQ ID NO: 54868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatttagtggaaattcatc

SEQ ID NO: 54869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttagtggaaattcatctg

SEQ ID NO: 54870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtggaaattcatctggaga

SEQ ID NO: 54871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattcatctggagatggta

SEQ ID NO: 54872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctggagatggtaaagtacta

SEQ ID NO: 54873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactatggtataaataacat

SEQ ID NO: 54874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgcaaactaacatgttca

SEQ ID NO: 54875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttatttctctgctctctct

SEQ ID NO: 54876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgctctctcttggaacta

SEQ ID NO: 54877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgctctctcttggaactaa

SEQ ID NO: 54878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaactaaaggctgtgatta

SEQ ID NO: 54879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaaggctgtgattatggc

SEQ ID NO: 54880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaggctgtgattatggca

SEQ ID NO: 54881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgattatggcaaggtatc

SEQ ID NO: 54882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgattatggcaaggtatct

SEQ ID NO: 54883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taggaaccctcaccataatc

SEQ ID NO: 54884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggaaccctcaccataatct

SEQ ID NO: 54885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttgttaaaaatatattca

SEQ ID NO: 54886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaatatattcaaagata

SEQ ID NO: 54887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaatatattcaaagataa

SEQ ID NO: 54888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaatatattcaaagataaa

SEQ ID NO: 54889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atattcaaagataaagggta

SEQ ID NO: 54890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagggtatggctattttttt

SEQ ID NO: 54891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggtatggctattttttta

SEQ ID NO: 54892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggtatggctatttttttaa

SEQ ID NO: 54893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agggtgaattaaatgtgtga

SEQ ID NO: 54894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcttactttctgccattt

SEQ ID NO: 54895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcttactttctgccatttt

SEQ ID NO: 54896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcttactttctgccattttg

SEQ ID NO: 54897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactttctgccattttgggg

SEQ ID NO: 54898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccattttggggcagaatttt

SEQ ID NO: 54899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagaattttcagaacctca

SEQ ID NO: 54900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagaacctcacagatataaa

SEQ ID NO: 54901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaacctcacagatataaat

SEQ ID NO: 54902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcacagatataaataggat

SEQ ID NO: 54903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacagatataaataggattg

SEQ ID NO: 54904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaataggattggagtcatg

SEQ ID NO: 54905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatgaagaatattccaaat

SEQ ID NO: 54906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccaaattagataacaatca

SEQ ID NO: 54907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaaattagataacaatcac

SEQ ID NO: 54908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcacaggatcacaaatgaa

SEQ ID NO: 54909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcacaggatcacaaatgaat

SEQ ID NO: 54910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggatcacaaatgaatagg

SEQ ID NO: 54911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttcctcaaatttatattc

SEQ ID NO: 54912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctcaaatttatattccag

SEQ ID NO: 54913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctcaaatttatattccaga

SEQ ID NO: 54914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaatttatattccagaagg

SEQ ID NO: 54915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctaaacatttgctttatct

SEQ ID NO: 54916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgctttatctcagaatcc

SEQ ID NO: 54917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctgatcaaatttatattc

SEQ ID NO: 54918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatcaaatttatattccag

SEQ ID NO: 54919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatcaaatttatattccaga

SEQ ID NO: 54920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attattatttttaaatttat

SEQ ID NO: 54921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattatttttaaatttatt

SEQ ID NO: 54922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaggaatataactttgac

SEQ ID NO: 54923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaggaatataactttgacc

SEQ ID NO: 54924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaatataactttgaccag

SEQ ID NO: 54925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaatataactttgaccagg

SEQ ID NO: 54926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataactttgaccaggaggct

SEQ ID NO: 54927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaccaggaggcttggattct

SEQ ID NO: 54928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggcttggattctgagata

SEQ ID NO: 54929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttggattctgagataaagc

SEQ ID NO: 54930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgagataaagcaagtgca

SEQ ID NO: 54931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgagataaagcaagtgcat

SEQ ID NO: 54932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agcaagtgcataggcaaaaa

SEQ ID NO: 54933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcacaacaattcaatgaca

SEQ ID NO: 54934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcacaacaattcaatgacaa

SEQ ID NO: 54935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggtgcttaacttttattta

SEQ ID NO: 54936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaaaatgcaaaatttact

SEQ ID NO: 54937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaaaatttacttagtgacc

SEQ ID NO: 54938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatttacttagtgacctg

SEQ ID NO: 54939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacctggagtttccataaa

SEQ ID NO: 54940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcatttgcttgtaactccc

SEQ ID NO: 54941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttgcttgtaactccccag

SEQ ID NO: 54942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgcttgtaactccccagt

SEQ ID NO: 54943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtaactccccagtgggaa

SEQ ID NO: 54944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaactccccagtgggaaa

SEQ ID NO: 54945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtgggaaaaggtattgcc

SEQ ID NO: 54946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgggaaaaggtattgcct

SEQ ID NO: 54947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgggaaaaggtattgccta

SEQ ID NO: 54948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggaaaaggtattgcctag

SEQ ID NO: 54949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaggggacttaacctccac

SEQ ID NO: 54950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggggacttaacctccaca

SEQ ID NO: 54951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaaggattgtctaaaaac

SEQ ID NO: 54952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaaaaacaagaaatatctg

SEQ ID NO: 54953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacactaaccttaaaactt

SEQ ID NO: 54954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaccttaaaacttcagtttt

SEQ ID NO: 54955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaacactttaacaaaact

SEQ ID NO: 54956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaaaactgagtgaaaaat

SEQ ID NO: 54957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgactttactaaaaattaa

SEQ ID NO: 54958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gactttactaaaaattaaca

SEQ ID NO: 54959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttactaaaaattaacaga

SEQ ID NO: 54960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttactaaaaattaacagaga

SEQ ID NO: 54961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tactaaaaattaacagagag

SEQ ID NO: 54962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaaaaattaacagagagag

SEQ ID NO: 54963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctttattaaaataaatct

SEQ ID NO: 54964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataaatctaagattctaaa

SEQ ID NO: 54965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatctaagattctaaatag

SEQ ID NO: 54966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattgatctacttgaccgtt

SEQ ID NO: 54967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacttgaccgttgagaaaac

SEQ ID NO: 54968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaccgttgagaaaacaaga

SEQ ID NO: 54969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaattcaatttgtttactc

SEQ ID NO: 54970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttgtttactcaagtatt

SEQ ID NO: 54971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaagcaccttctctgtgca

SEQ ID NO: 54972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtgcaaagccttgtaaaa

SEQ ID NO: 54973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccttgtaaaatggtctgtg

SEQ ID NO: 54974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctgtgtggattacaacta

SEQ ID NO: 54975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtttgatttaatcatatc

SEQ ID NO: 54976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtttgatttaatcatatct

SEQ ID NO: 54977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatttaatcatatctaggat

SEQ ID NO: 54978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatctaggattagaaaatg

SEQ ID NO: 54979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatctaggattagaaaatga

SEQ ID NO: 54980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atctaggattagaaaatgaa

SEQ ID NO: 54981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggtccctaaattcattaac

SEQ ID NO: 54982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccctaaattcattaactagc

SEQ ID NO: 54983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctaaattcattaactagct

SEQ ID NO: 54984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattcattaactagctaggc

SEQ ID NO: 54985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcattaactagctaggca

SEQ ID NO: 54986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaaggatattctttcccat

SEQ ID NO: 54987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaggatattctttcccatc

SEQ ID NO: 54988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggaattctcctaaattgc

SEQ ID NO: 54989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatttatacaacaactcaa

SEQ ID NO: 54990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caactcaaaagttttaatac

SEQ ID NO: 54991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttttaatactggtataa

SEQ ID NO: 54992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactggtataaaagaaaaaa

SEQ ID NO: 54993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagaacaaaacaaaatgaaa

SEQ ID NO: 54994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaacaaaacaaaatgaaat

SEQ ID NO: 54995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacaaaacaaaatgaaatgg

SEQ ID NO: 54996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaatgggagttcttgaaa

SEQ ID NO: 54997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgggagttcttgaaatgg

SEQ ID NO: 54998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgggagttcttgaaatgga

SEQ ID NO: 54999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaaatggaaggcacatgtt

SEQ ID NO: 55000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatggaaggcacatgttca

SEQ ID NO: 55001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaggcacatgttcagagt

SEQ ID NO: 55002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaggcacatgttcagagta

SEQ ID NO: 55003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttcagagtaaggcacatt

SEQ ID NO: 55004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcacattcagactaaaaac

SEQ ID NO: 55005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagactaaaaaccagatctc

SEQ ID NO: 55006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agactaaaaaccagatctct

SEQ ID NO: 55007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gactaaaaaccagatctctg

SEQ ID NO: 55008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccagatctctggggacaa

SEQ ID NO: 55009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accagatctctggggacaat

SEQ ID NO: 55010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctctggggacaatgggta

SEQ ID NO: 55011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctctggggacaatgggtat

SEQ ID NO: 55012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggggacaatgggtatggga

SEQ ID NO: 55013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacaatgggtatgggaaagc

SEQ ID NO: 55014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggaaagctggaaactctct

SEQ ID NO: 55015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaagctggaaactctctta

SEQ ID NO: 55016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttagagtctacgaattata

SEQ ID NO: 55017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagagtctacgaattatat

SEQ ID NO: 55018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaatcaccaatgaatca

SEQ ID NO: 55019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaatcacagacctaaacgt

SEQ ID NO: 55020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcacagacctaaacgtca

SEQ ID NO: 55021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagacctaaacgtcagagt

SEQ ID NO: 55022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttagaactgtaaatttct

SEQ ID NO: 55023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatttctaagaaaatatca

SEQ ID NO: 55024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttctaagaaaatatcat

SEQ ID NO: 55025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttctaagaaaatatcata

SEQ ID NO: 55026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcatagggaaaaatcttc

SEQ ID NO: 55027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggaaaaatcttcgagacat

SEQ ID NO: 55028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatcttcgagacattagatt

SEQ ID NO: 55029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacattagatttggcaca

SEQ ID NO: 55030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagatttggcacatggaca

SEQ ID NO: 55031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacatggacatggaaccaa

SEQ ID NO: 55032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tggacatggaaccaaaagca

SEQ ID NO: 55033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaaaagcacggtcaacaa

SEQ ID NO: 55034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacggtcaacaaaagaaaaa

SEQ ID NO: 55035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cggtcaacaaaagaaaaaaa

SEQ ID NO: 55036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagaaaaaaagagctgaat

SEQ ID NO: 55037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgaaactgttgtgcatca

SEQ ID NO: 55038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgcatcaaagaacactac

SEQ ID NO: 55039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaaagaacactactaga

SEQ ID NO: 55040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacactactagaaagtgaa

SEQ ID NO: 55041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacactactagaaagtgaaa

SEQ ID NO: 55042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaaaggcaatccatatga

SEQ ID NO: 55043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaaggcaatccatatgat

SEQ ID NO: 55044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaggcaatccatatgatgg

SEQ ID NO: 55045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcaaatcatatatctgat

SEQ ID NO: 55046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcaaatcatatatctgata

SEQ ID NO: 55047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaaatcatatatctgataa

SEQ ID NO: 55048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctgataagggattaacat

SEQ ID NO: 55049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcctcaacaaaaaataaac

SEQ ID NO: 55050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaacaaaaaataaacaag

SEQ ID NO: 55051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcagattaaaaatgaaca

SEQ ID NO: 55052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcagattaaaaatgaacaa

SEQ ID NO: 55053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgaacaaaggatttgaa

SEQ ID NO: 55054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgaaaagacatttttcca

SEQ ID NO: 55055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagacatttttccaaaga

SEQ ID NO: 55056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttccaaagaaagtcaat

SEQ ID NO: 55057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagaaagtcaatcagtaca

SEQ ID NO: 55058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagaaagtcaatcagtacat

SEQ ID NO: 55059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtcaatcagtacatggg

SEQ ID NO: 55060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctcaacatcaccgatcatt

SEQ ID NO: 55061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcaacatcaccgatcattt

SEQ ID NO: 55062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaaatatcacttcacact

SEQ ID NO: 55063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatatcacttcacacttggt

SEQ ID NO: 55064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacttcacacttggtcgga

SEQ ID NO: 55065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttattgtttaaaaaaaaaa

SEQ ID NO: 55066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattgtttaaaaaaaaaaa

SEQ ID NO: 55067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttaaaaaaaaaaaaggaa

SEQ ID NO: 55068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaggaaaagaaacattgac

SEQ ID NO: 55069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaaaagaaacattgaca

SEQ ID NO: 55070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggaaaagaaacattgacaa

SEQ ID NO: 55071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaaacattgacaagggtg

SEQ ID NO: 55072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaacattgacaagggtgtg

SEQ ID NO: 55073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taacccttgtgcattgctga

SEQ ID NO: 55074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacccttgtgcattgctgat

SEQ ID NO: 55075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgctgataggaatataaaa

SEQ ID NO: 55076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataggaatataaaatagtg

SEQ ID NO: 55077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaaatagtgcagctgctg

SEQ ID NO: 55078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctgctgtggaaaacactg

SEQ ID NO: 55079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgctgtggaaaacactgtgg

SEQ ID NO: 55080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggttcctcaaaaaattaaa

SEQ ID NO: 55081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacagaaatatcacatgatc

SEQ ID NO: 55082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatccagcaattctactt

SEQ ID NO: 55083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatccagcaattctacttt

SEQ ID NO: 55084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatccagcaattctacttta

SEQ ID NO: 55085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatacatcctaaacaattaa

SEQ ID NO: 55086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatcctaaacaattaatag

SEQ ID NO: 55087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catcctaaacaattaataga

SEQ ID NO: 55088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcctaaacaattaatagaa

SEQ ID NO: 55089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaatagaagggacgcatg

SEQ ID NO: 55090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatctgtacaccaatgttca

SEQ ID NO: 55091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtacaccaatgttcatag

SEQ ID NO: 55092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcatagcagcactaatca

SEQ ID NO: 55093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catagcagcactaatcacag

SEQ ID NO: 55094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactaatcacagtagccaaa

SEQ ID NO: 55095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaacccaaatgtctatcaa

SEQ ID NO: 55096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgtctatcaacagatgaa

SEQ ID NO: 55097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcacaataaaatactaca

SEQ ID NO: 55098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttctgatatatgctacgacc

SEQ ID NO: 55099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caccttgaaaacattatgct

SEQ ID NO: 55100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacattatgctaagtgaaat

SEQ ID NO: 55101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatgctaagtgaaataagc

SEQ ID NO: 55102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaataagccagacatgaa

SEQ ID NO: 55103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatgaaaagacaaatgcta

SEQ ID NO: 55104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgaaaagacaaatgctat

SEQ ID NO: 55105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaaaagacaaatgctata

SEQ ID NO: 55106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatagggttccacttacat

SEQ ID NO: 55107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatagggttccacttacatg

SEQ ID NO: 55108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttccacttacatgaggtacc

SEQ ID NO: 55109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttacatgaggtacctagaa

SEQ ID NO: 55110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctagaatagtcacattca

SEQ ID NO: 55111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctagaatagtcacattcata

SEQ ID NO: 55112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatagtcacattcatagaga

SEQ ID NO: 55113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtcacattcatagagaaag

SEQ ID NO: 55114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattcatagagaaagtagaa

SEQ ID NO: 55115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatagagaaagtagaatag

SEQ ID NO: 55116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaagtagaatagtggttac

SEQ ID NO: 55117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagtagaatagtggttact

SEQ ID NO: 55118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatagtggttactgggtga

SEQ ID NO: 55119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatagtggttactgggtgat

SEQ ID NO: 55120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atagtggttactgggtgata

SEQ ID NO: 55121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagtggttactgggtgatag

SEQ ID NO: 55122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggttactgggtgatagggg

SEQ ID NO: 55123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttactgggtgataggggaa

SEQ ID NO: 55124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactgggtgataggggaaga

SEQ ID NO: 55125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgggtgataggggaagag

SEQ ID NO: 55126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggtgataggggaagagag

SEQ ID NO: 55127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gataggggaagagaggagtg

SEQ ID NO: 55128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggggaagagaggagtgtg

SEQ ID NO: 55129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgtggagtcattgtttaa

SEQ ID NO: 55130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcattgtttaatagttacc

SEQ ID NO: 55131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagttaccgagtttttgtt

SEQ ID NO: 55132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaatgatgaaaatgttctg

SEQ ID NO: 55133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatgaaaatgttctgaaga

SEQ ID NO: 55134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaatgttctgaagatgga

SEQ ID NO: 55135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgttctgaagatggatgg

SEQ ID NO: 55136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctaaactgtacatttgaaa

SEQ ID NO: 55137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacatttgaaatggttaaaa

SEQ ID NO: 55138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atataaatttttaaattcac

SEQ ID NO: 55139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaattcactagcgtgtttt

SEQ ID NO: 55140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcgtgttttgagatccgt

SEQ ID NO: 55141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcgtgttttgagatccgta

SEQ ID NO: 55142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgttttgagatccgtaagg

SEQ ID NO: 55143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgagatccgtaaggcaga

SEQ ID NO: 55144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagatccgtaaggcagaaa

SEQ ID NO: 55145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccgtaaggcagaaagagt

SEQ ID NO: 55146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaggcagaaagagtcagt

SEQ ID NO: 55147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggcagaaagagtcagtaa

SEQ ID NO: 55148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagtaagagaacaaaatca

SEQ ID NO: 55149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaagagaacaaaatcacag

SEQ ID NO: 55150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagaacaaaatcacagcagt

SEQ ID NO: 55151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaatcacagcagttagcaac

SEQ ID NO: 55152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cggtcaaccctgacaacatg

SEQ ID NO: 55153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacaacatgcggtgtctcct

SEQ ID NO: 55154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctccttggtatctgttttgc

SEQ ID NO: 55155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccttggtatctgttttgct

SEQ ID NO: 55156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggtatctgttttgctagg

SEQ ID NO: 55157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatctgttttgctaggcag

SEQ ID NO: 55158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtagtcatttatatctatg

SEQ ID NO: 55159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcagtaccactatttcat

SEQ ID NO: 55160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attactgtactcccaccatt

SEQ ID NO: 55161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttccaaaatgcaaacattta

SEQ ID NO: 55162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattgtaatctttgtcttat

SEQ ID NO: 55163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccctgccccctgccccaaa

SEQ ID NO: 55164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccccctgccccaaatagt

SEQ ID NO: 55165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccccctgccccaaatagtaa

SEQ ID NO: 55166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccctgccccaaatagtaag

SEQ ID NO: 55167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccaaatagtaagaggttcc

SEQ ID NO: 55168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccaagaatccaatccatta

SEQ ID NO: 55169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaatccaatccattacaga

SEQ ID NO: 55170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaatccaatccattacagac

SEQ ID NO: 55171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaatccattacagacagg

SEQ ID NO: 55172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatccattacagacaggaa

SEQ ID NO: 55173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacagacaggaagagaata

SEQ ID NO: 55174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacagacaggaagagaatat

SEQ ID NO: 55175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacatttacatatacataaa

SEQ ID NO: 55176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catatacataaatagtaaat

SEQ ID NO: 55177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttacatctaaatcacaaaaa

SEQ ID NO: 55178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaaaacattatttttgta

SEQ ID NO: 55179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattatttttgtatagaaat

SEQ ID NO: 55180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttctcaaacatttttttc

SEQ ID NO: 55181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggttttatgttacccatgtc

SEQ ID NO: 55182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgttacccatgtccaga

SEQ ID NO: 55183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgttacccatgtccagaaa

SEQ ID NO: 55184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccatgtccagaaagagatc

SEQ ID NO: 55185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaagagatccagttaaaa

SEQ ID NO: 55186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagagatccagttaaaaaa

SEQ ID NO: 55187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcacactcatccctttcca

SEQ ID NO: 55188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccaaagttgtacccatgc

SEQ ID NO: 55189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtacccatgctggtaattt

SEQ ID NO: 55190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgctggtaattttagcat

SEQ ID NO: 55191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagcattggtttatcacg

SEQ ID NO: 55192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatcacgcagccctcgacg

SEQ ID NO: 55193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcacgcagccctcgacgc

SEQ ID NO: 55194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acgcagccctcgacgcaggt

SEQ ID NO: 55195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagtaatccctacaaaatc

SEQ ID NO: 55196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtctgtatttcaaccatgc

SEQ ID NO: 55197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaatacatcaaatatgcct

SEQ ID NO: 55198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatacatcaaatatgcctt

SEQ ID NO: 55199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatacatcaaatatgcctta

SEQ ID NO: 55200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caattgctgttttttgtgac

SEQ ID NO: 55201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtgactagaatgattctt

SEQ ID NO: 55202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaatgattcttcagttgtt

SEQ ID NO: 55203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgattcttcagttgtttagc

SEQ ID NO: 55204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttgtttagctagctccct

SEQ ID NO: 55205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataccctgtataaaattttt

SEQ ID NO: 55206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctgttttattgtttttca

SEQ ID NO: 55207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttttcacagcatatctta

SEQ ID NO: 55208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catatcttatggtacaatga

SEQ ID NO: 55209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttatggtacaatgatgga

SEQ ID NO: 55210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatggtacaatgatggatag

SEQ ID NO: 55211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcttcattatctcttaaaat

SEQ ID NO: 55212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctacaataaaactttatg

SEQ ID NO: 55213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaataaaactttatgaag

SEQ ID NO: 55214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaataaaactttatgaaga

SEQ ID NO: 55215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaactttatgaagaagg

SEQ ID NO: 55216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaactttatgaagaaggaa

SEQ ID NO: 55217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactttatgaagaaggaaga

SEQ ID NO: 55218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actttatgaagaaggaagag

SEQ ID NO: 55219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttatgaagaaggaagaga

SEQ ID NO: 55220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaggaagagagggaaaa

SEQ ID NO: 55221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaagagagggaaaaaaga

SEQ ID NO: 55222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagagagggaaaaaagaaa

SEQ ID NO: 55223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagagagggaaaaaagaaag

SEQ ID NO: 55224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agagagggaaaaaagaaaga

SEQ ID NO: 55225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagggaaaaaagaaagaggg

SEQ ID NO: 55226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggaaaaaagaaagaggga

SEQ ID NO: 55227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaagaaagagggaagga

SEQ ID NO: 55228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaaagagggaaggaaag

SEQ ID NO: 55229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaagagggaaggaaaga

SEQ ID NO: 55230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggaattgcttttaaattc

SEQ ID NO: 55231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggaattgcttttaaattcc

SEQ ID NO: 55232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgcttttaaattccagg

SEQ ID NO: 55233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcttttaaattccaggaa

SEQ ID NO: 55234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaggaagagtataaatgct

SEQ ID NO: 55235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaagagtataaatgctga

SEQ ID NO: 55236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaagagtataaatgctgag

SEQ ID NO: 55237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagagtataaatgctgagag

SEQ ID NO: 55238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtataaatgctgagaggagt

SEQ ID NO: 55239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataaatgctgagaggagtg

SEQ ID NO: 55240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctgagaggagtgaggttgt

SEQ ID NO: 55241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgaggttgtgagttct

SEQ ID NO: 55242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggttgtgagttcttggaac

SEQ ID NO: 55243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgagttcttggaactggcc

SEQ ID NO: 55244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagttcttggaactggcctg

SEQ ID NO: 55245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttcttggaactggcctgg

SEQ ID NO: 55246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttcttggaactggcctgga

SEQ ID NO: 55247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaactggcctggagggact

SEQ ID NO: 55248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actggcctggagggactcag

SEQ ID NO: 55249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagccgcttaccactgccct

SEQ ID NO: 55250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agccgcttaccactgccctt

SEQ ID NO: 55251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgcccttgggatctctgc

SEQ ID NO: 55252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgcccttgggatctctgcc

SEQ ID NO: 55253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctccctacaaacctcaa

SEQ ID NO: 55254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatggcaccaataccaact

SEQ ID NO: 55255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactcctgacctacacattt

SEQ ID NO: 55256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcctgacctacacattttg

SEQ ID NO: 55257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctgacctacacattttgg

SEQ ID NO: 55258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacacattttggaggccaac

SEQ ID NO: 55259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
attttggaggccaactagac

SEQ ID NO: 55260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cggatctaatgattaatccc

SEQ ID NO: 55261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggatctaatgattaatccct

SEQ ID NO: 55262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatgattaatccctaggct

SEQ ID NO: 55263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccctaggctaagataaat

SEQ ID NO: 55264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaggctaagataaatcagt

SEQ ID NO: 55265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataaatcagttggaaattt

SEQ ID NO: 55266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgttttttcttatctgc

SEQ ID NO: 55267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctgccagtctacctgtt

SEQ ID NO: 55268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatatctgtcactgtcaa

SEQ ID NO: 55269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtccctttacttatttcact

SEQ ID NO: 55270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcacttagcatgtctcttc

SEQ ID NO: 55271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcacttagcatgtctcttct

SEQ ID NO: 55272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccatgcatgctgtcacaaa

SEQ ID NO: 55273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcatgctgtcacaaatagt

SEQ ID NO: 55274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagatttccttcttttttt

SEQ ID NO: 55275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagatttccttcttttttta

SEQ ID NO: 55276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttccttctttttttaaggc

SEQ ID NO: 55277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataatattctattttatata

SEQ ID NO: 55278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatctgttgatgatcatt

SEQ ID NO: 55279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatctgttgatgatcattt

SEQ ID NO: 55280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctattgtgaataatgctg

SEQ ID NO: 55281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaataatgctgcagtaaaca

SEQ ID NO: 55282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatgctgcagtaaacacag

SEQ ID NO: 55283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagtgcatatatctcttt

SEQ ID NO: 55284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagattctgatttcaattgc

SEQ ID NO: 55285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttcaattgctggatcata

SEQ ID NO: 55286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaattgctggatcatatgg

SEQ ID NO: 55287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttctatttttaatttttt

SEQ ID NO: 55288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttctatttttaattttttg

SEQ ID NO: 55289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacttccatattattttcca

SEQ ID NO: 55290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttccatattattttccatag

SEQ ID NO: 55291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctattatacattcccaccaa

SEQ ID NO: 55292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatacattcccaccaacag

SEQ ID NO: 55293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacctttcacttttttataa

SEQ ID NO: 55294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttataacagccatcttaa

SEQ ID NO: 55295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttataacagccatcttaac

SEQ ID NO: 55296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagccatcttaacaggtgt

SEQ ID NO: 55297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgagatgattatctcattg

SEQ ID NO: 55298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgataaaaccttaaccact

SEQ ID NO: 55299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaccttaaccacttagtc

SEQ ID NO: 55300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaccttaaccacttagtcta

SEQ ID NO: 55301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accttaaccacttagtctag

SEQ ID NO: 55302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaccacttagtctagaggat

SEQ ID NO: 55303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatccacaaatcactaaaa

SEQ ID NO: 55304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaatcactaaaatagatt

SEQ ID NO: 55305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatagattgagacgtatca

SEQ ID NO: 55306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagacgtatcatagaactc

SEQ ID NO: 55307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagacgtatcatagaactca

SEQ ID NO: 55308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agacgtatcatagaactcaa

SEQ ID NO: 55309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcaagggccaaatttccca

SEQ ID NO: 55310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccatggtttttatatccca

SEQ ID NO: 55311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtttttatatcccaaagta

SEQ ID NO: 55312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcccaaagtacagtatct

SEQ ID NO: 55313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccaaagtacagtatctaag

SEQ ID NO: 55314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacagtatctaagtggataa

SEQ ID NO: 55315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacataatgtaaaataaat

SEQ ID NO: 55316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactgttttaaaacccttaa

SEQ ID NO: 55317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttcttgcattactgatgt

SEQ ID NO: 55318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttagacaatttaactgact

SEQ ID NO: 55319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaactgacttagataatt

SEQ ID NO: 55320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgagtcttcatgacaat

SEQ ID NO: 55321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacaataagtactgtgatt

SEQ ID NO: 55322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaataagtactgtgattt

SEQ ID NO: 55323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatttgtactcctccaata

SEQ ID NO: 55324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctaaatttttattttcc

SEQ ID NO: 55325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accatcatcttatcctgcac

SEQ ID NO: 55326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcatacttctccatctgc

SEQ ID NO: 55327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttctccatctgctagctc

SEQ ID NO: 55328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttctccatctgctagctcc

SEQ ID NO: 55329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccctgtttcttctccattt

SEQ ID NO: 55330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcagaataaacttcatcc

SEQ ID NO: 55331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttttaattttttttctt

SEQ ID NO: 55332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taattttttttcttgagact

SEQ ID NO: 55333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgagtctcgctctgttgcc

SEQ ID NO: 55334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagtctcgctctgttgccc

SEQ ID NO: 55335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctcgctctgttgcccagg

SEQ ID NO: 55336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcgctctgttgcccaggc

SEQ ID NO: 55337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcgctctgttgcccaggcag

SEQ ID NO: 55338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgttgcccaggcaggagtg

SEQ ID NO: 55339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgcccaggcaggagtgcag

SEQ ID NO: 55340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagtgcagtggctcgatct

SEQ ID NO: 55341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactgcaacctccatctcc

SEQ ID NO: 55342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgcaacctccatctccc

SEQ ID NO: 55343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caacctccatctcccaggtt

SEQ ID NO: 55344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacctccatctcccaggttc

SEQ ID NO: 55345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaggcaattctcctgcct

SEQ ID NO: 55346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctccc

SEQ ID NO: 55347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctgcctcagcctcccgag

SEQ ID NO: 55348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcccgagaagc

SEQ ID NO: 55349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcccgagaagct

SEQ ID NO: 55350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccgagaagctgggacta

SEQ ID NO: 55351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccgagaagctgggactac

SEQ ID NO: 55352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagctgggactacaggtgc

SEQ ID NO: 55353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggtgctggccaccatgcc

SEQ ID NO: 55354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctggccaccatgcctgga

SEQ ID NO: 55355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatagtttttgtattttttt

SEQ ID NO: 55356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtttttgtattttttttag

SEQ ID NO: 55357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttgtattttttttagta

SEQ ID NO: 55358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtattttttttagtagaga

SEQ ID NO: 55359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtattttttttagtagagat

SEQ ID NO: 55360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattttttttagtagagatg

SEQ ID NO: 55361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggtttcactatgttgac

SEQ ID NO: 55362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggtttcactatgttgacc

SEQ ID NO: 55363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcactatgttgaccaggc

SEQ ID NO: 55364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtctccaactcctgacctc

SEQ ID NO: 55365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactcctgacctcaagtgat

SEQ ID NO: 55366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaagtgatcagcctgcct

SEQ ID NO: 55367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcctgcctcagccttcca

SEQ ID NO: 55368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagccttccaaagtgc

SEQ ID NO: 55369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ccttccaaagtgctggatta

SEQ ID NO: 55370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttccaaagtgctggattac

SEQ ID NO: 55371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgctggattacgggcgt

SEQ ID NO: 55372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgggcgtaagccaccgcgcc

SEQ ID NO: 55373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaccgcgcctggcccaccc

SEQ ID NO: 55374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttcaaatcttttctacct

SEQ ID NO: 55375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttcaaatcttttctacctt

SEQ ID NO: 55376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcaaatcttttctaccttg

SEQ ID NO: 55377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatcttttctaccttgggg

SEQ ID NO: 55378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcttttctaccttgggga

SEQ ID NO: 55379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaggcctttttcccattt

SEQ ID NO: 55380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacaaaatatgcgaatca

SEQ ID NO: 55381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatatgcgaatcatagca

SEQ ID NO: 55382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcgaatcatagcaaagtc

SEQ ID NO: 55383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcatagcaaagtcaagtca

SEQ ID NO: 55384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagcaaagtcaagtcacag

SEQ ID NO: 55385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtagtgcaataatactcc

SEQ ID NO: 55386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgcaataatactcctagac

SEQ ID NO: 55387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcaataatactcctagacc

SEQ ID NO: 55388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatactcctagaccagga

SEQ ID NO: 55389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcctagaccaggaaagtg

SEQ ID NO: 55390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaaaacactttaaatgca

SEQ ID NO: 55391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaacactttaaatgcat

SEQ ID NO: 55392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttaacacaatatacccct

SEQ ID NO: 55393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttaacacaatatacccctc

SEQ ID NO: 55394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaatatacccctcaggaat

SEQ ID NO: 55395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccctcaggaattggtgtcc

SEQ ID NO: 55396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaggaattggtgtccaag

SEQ ID NO: 55397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtccaagaagaaaattgaaa

SEQ ID NO: 55398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttttttgttgttttctat

SEQ ID NO: 55399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagctgtaattacatgatt

SEQ ID NO: 55400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgcaaatgtaattttattt

SEQ ID NO: 55401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttattttagctccatt

SEQ ID NO: 55402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttattttagctccatta

SEQ ID NO: 55403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttattttagctccattaa

SEQ ID NO: 55404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagggttaaacatatttga

SEQ ID NO: 55405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacatatttgatagaatgct

SEQ ID NO: 55406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatttgatagaatgcttgg

SEQ ID NO: 55407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcttggtagcgtaaccac

SEQ ID NO: 55408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcttggtagcgtaaccacc

SEQ ID NO: 55409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccaccaggtatatctgtg

SEQ ID NO: 55410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accaccaggtatatctgtgt

SEQ ID NO: 55411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaccaggtatatctgtgtg

SEQ ID NO: 55412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtatgtgcaaacgtattct

SEQ ID NO: 55413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacgtattcttggaatatat

SEQ ID NO: 55414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataagatttctttcctataa

SEQ ID NO: 55415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaatgtgtatgttattc

SEQ ID NO: 55416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtgtatgttattcaagtt

SEQ ID NO: 55417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagtttagtaaccattgt

SEQ ID NO: 55418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtaaccattgtgagtctt

SEQ ID NO: 55419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaccattgtgagtctttgga

SEQ ID NO: 55420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accattgtgagtctttggaa

SEQ ID NO: 55421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtgagtctttggaaaggt

SEQ ID NO: 55422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgagtctttggaaaggtt

SEQ ID NO: 55423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaaggttaggtaatttct

SEQ ID NO: 55424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaggtaatttctgagcct

SEQ ID NO: 55425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttagtgttctcacctcaaa

SEQ ID NO: 55426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgttctcacctcaaatgg

SEQ ID NO: 55427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacctcaaatggtggtcat

SEQ ID NO: 55428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacctcaaatggtggtcatg

SEQ ID NO: 55429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggtggtcatgaggatttaaa

SEQ ID NO: 55430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtcatgaggatttaaacg

SEQ ID NO: 55431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcccttaacaaactgct

SEQ ID NO: 55432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccttaacaaactgctcagt

SEQ ID NO: 55433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaactgctcagttagcatt

SEQ ID NO: 55434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactgctcagttagcatta

SEQ ID NO: 55435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actgctcagttagcattaag

SEQ ID NO: 55436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaggagacgtccatacat

SEQ ID NO: 55437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gactgttacattaatattat

SEQ ID NO: 55438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaatattatcagtaatgt

SEQ ID NO: 55439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattatcagtaatgttagc

SEQ ID NO: 55440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtatgtatttttccttgtaa

SEQ ID NO: 55441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttgtaacagcataattgc

SEQ ID NO: 55442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcataattgctggccttgca

SEQ ID NO: 55443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattgctggccttgcacag

SEQ ID NO: 55444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacctgtaatcccaacactt

SEQ ID NO: 55445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtaatcccaacactttag

SEQ ID NO: 55446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccaacactttaga

SEQ ID NO: 55447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccaacactttagaaggcc

SEQ ID NO: 55448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaacactttagaaggccg

SEQ ID NO: 55449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacactttagaaggccgagg

SEQ ID NO: 55450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acactttagaaggccgaggt

SEQ ID NO: 55451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttagaaggccgaggtggg

SEQ ID NO: 55452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgaggtgggcagatcacct

SEQ ID NO: 55453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgaggtgggcagatcacctg

SEQ ID NO: 55454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgggcagatcacctgaggt

SEQ ID NO: 55455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggcagatcacctgaggtc

SEQ ID NO: 55456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacctgaggtcaggaattc

SEQ ID NO: 55457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaggtcaggaattcgagac

SEQ ID NO: 55458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggaattcgagactagtc

SEQ ID NO: 55459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgagactagtctggccaaca

SEQ ID NO: 55460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctactaaaactgcaaaat

SEQ ID NO: 55461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
actaaaactgcaaaattagc

SEQ ID NO: 55462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaaaactgcaaaattagcc

SEQ ID NO: 55463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgcaaaattagccgggca

SEQ ID NO: 55464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaaaattagccgggcatgg

SEQ ID NO: 55465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggtacatgcctgtaatcc

SEQ ID NO: 55466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctgtaatcccagctact

SEQ ID NO: 55467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtaatcccagctactt

SEQ ID NO: 55468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccagctacttgg

SEQ ID NO: 55469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagctacttggg

SEQ ID NO: 55470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctacttgggaggct

SEQ ID NO: 55471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctacttgggaggctg

SEQ ID NO: 55472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctacttgggaggctgagg

SEQ ID NO: 55473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctacttgggaggctgaggc

SEQ ID NO: 55474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttgggaggctgaggcag

SEQ ID NO: 55475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaggagaatcacttgaatc

SEQ ID NO: 55476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagaatcacttgaatct

SEQ ID NO: 55477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatcacttgaatctgg

SEQ ID NO: 55478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaatcacttgaatctggg

SEQ ID NO: 55479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcacttgaatctgggagg

SEQ ID NO: 55480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacttgaatctgggaggca

SEQ ID NO: 55481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacttgaatctgggaggcag

SEQ ID NO: 55482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctgggaggcagaggttg

SEQ ID NO: 55483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggaggcagaggttgcagc

SEQ ID NO: 55484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacatcgtaccactgcactc

SEQ ID NO: 55485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtaccactgcactccagcc

SEQ ID NO: 55486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaccactgcactccagcct

SEQ ID NO: 55487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcactccagcctgggcaa

SEQ ID NO: 55488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgggcaaca

SEQ ID NO: 55489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cctgggcaacagagtgaaac

SEQ ID NO: 55490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattaaaaaaaaaaaaaaa

SEQ ID NO: 55491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attaaaaaaaaaaaaaaaaa

SEQ ID NO: 55492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaaaaaaaaaaaaaaag

SEQ ID NO: 55493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaaaaaaaaaaagaggc

SEQ ID NO: 55494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaaaaaaaaaagaggct

SEQ ID NO: 55495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaaaaagaggctgggca

SEQ ID NO: 55496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaagaggctgggcatgg

SEQ ID NO: 55497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctataatcc

SEQ ID NO: 55498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctataatcccagcactt

SEQ ID NO: 55499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctataatcccagcacttt

SEQ ID NO: 55500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctataatcccagcactttg

SEQ ID NO: 55501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctataatcccagcactttgg

SEQ ID NO: 55502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tataatcccagcactttggg

SEQ ID NO: 55503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccagcactttggggggcc

SEQ ID NO: 55504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttggggggcct

SEQ ID NO: 55505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agcactttggggggcctagg

SEQ ID NO: 55506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttggggggcctaggc

SEQ ID NO: 55507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttggggggcctaggcggg

SEQ ID NO: 55508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcgggcagatcacctgaact

SEQ ID NO: 55509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgggcagatcacctgaactc

SEQ ID NO: 55510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcagatcacctgaactcag

SEQ ID NO: 55511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacctgaactcaggagttc

SEQ ID NO: 55512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaactcaggagttcaagac

SEQ ID NO: 55513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagaccagcctgcccaacc

SEQ ID NO: 55514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctactaaaaatacaaaat

SEQ ID NO: 55515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaaaaatacaaaattagc

SEQ ID NO: 55516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaaaatacaaaattagcc

SEQ ID NO: 55517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatacaaaattagccaggc

SEQ ID NO: 55518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatacaaaattagccaggcg

SEQ ID NO: 55519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaattagccaggcgagg

SEQ ID NO: 55520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtggctcatgcctgtaatcc

SEQ ID NO: 55521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgcctgtaatcccggctact

SEQ ID NO: 55522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtaatcccggctactc

SEQ ID NO: 55523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccggctactcgg

SEQ ID NO: 55524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccggctactcggg

SEQ ID NO: 55525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccggctactcgggaggct

SEQ ID NO: 55526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccggctactcgggaggctg

SEQ ID NO: 55527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggctactcgggaggctgagg

SEQ ID NO: 55528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctactcgggaggctgaggc

SEQ ID NO: 55529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactcgggaggctgaggcag

SEQ ID NO: 55530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaggagaattgcttgaacc

SEQ ID NO: 55531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagaattgcttgaacct

SEQ ID NO: 55532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaattgcttgaacctgg

SEQ ID NO: 55533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaattgcttgaacctggg

SEQ ID NO: 55534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aattgcttgaacctgggagg

SEQ ID NO: 55535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttgaacctgggaggcgg

SEQ ID NO: 55536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacctgggaggcggaagttg

SEQ ID NO: 55537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggaggcggaagttgcagt

SEQ ID NO: 55538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcggaagttgcagtgagcc

SEQ ID NO: 55539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatcgtaccattgcactc

SEQ ID NO: 55540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtaccattgcactccagcc

SEQ ID NO: 55541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaccattgcactccagcct

SEQ ID NO: 55542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcactccagcctgggcaac

SEQ ID NO: 55543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactccagcctgggcaacaa

SEQ ID NO: 55544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgggcaacaagagtgaaact

SEQ ID NO: 55545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcggtctcaaaaaaaaaaaa

SEQ ID NO: 55546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattttgattataatattct

SEQ ID NO: 55547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attctaagttattaaatgcc

SEQ ID NO: 55548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatctacttatcatgtgt

SEQ ID NO: 55549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcatgtgtaagacacta

SEQ ID NO: 55550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatgtgtaagacactaaag

SEQ ID NO: 55551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agacactaaagtggctgttt

SEQ ID NO: 55552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctatatataacatataata

SEQ ID NO: 55553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataacatataatatagtcct

SEQ ID NO: 55554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatataatatagtccttag

SEQ ID NO: 55555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtaaatactactaattta

SEQ ID NO: 55556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtaaatactactaatttac

SEQ ID NO: 55557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatactactaatttacagga

SEQ ID NO: 55558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttacaggaaagcaatattt

SEQ ID NO: 55559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagaaattaatatttgact

SEQ ID NO: 55560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgactaagaccacatact

SEQ ID NO: 55561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaagaccacatactgagta

SEQ ID NO: 55562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagaccacatactgagtaa

SEQ ID NO: 55563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tactgagtaaaggaaatatt

SEQ ID NO: 55564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actgagtaaaggaaatattt

SEQ ID NO: 55565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactttataaaaatatttta

SEQ ID NO: 55566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattttacagtctgaaata

SEQ ID NO: 55567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttacagtctgaaatatag

SEQ ID NO: 55568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacagtctgaaatatagta

SEQ ID NO: 55569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatgtaatataaattttga

SEQ ID NO: 55570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgtaatataaattttgaa

SEQ ID NO: 55571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgaaaggcacttctctgcc

SEQ ID NO: 55572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctgcctagctgttctac

SEQ ID NO: 55573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacaagtgttcattcctaa

SEQ ID NO: 55574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcattcctaaaagtctgt

SEQ ID NO: 55575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtctgtcagctgatctca

SEQ ID NO: 55576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtctgtcagctgatctcat

SEQ ID NO: 55577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agctgatctcatgggattat

SEQ ID NO: 55578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattataagaaccttattcc

SEQ ID NO: 55579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttattcccagttgatccct

SEQ ID NO: 55580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcccagttgatccctgag

SEQ ID NO: 55581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcccagttgatccctgagt

SEQ ID NO: 55582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcctacctgaattaccat

SEQ ID NO: 55583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacctgaattaccatgagcc

SEQ ID NO: 55584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatgagccaagtttgtaaa

SEQ ID NO: 55585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catgagccaagtttgtaaat

SEQ ID NO: 55586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgagccaagtttgtaaatg

SEQ ID NO: 55587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtttgtaaatggggtaac

SEQ ID NO: 55588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaagaatacatattttgtt

SEQ ID NO: 55589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaatacatattttgttaa

SEQ ID NO: 55590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaatacatattttgttaag

SEQ ID NO: 55591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaatacatattttgttaaga

SEQ ID NO: 55592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatattttgttccatgca

SEQ ID NO: 55593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatgcaaagatcatttaca

SEQ ID NO: 55594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaagatcatttacaaagat

SEQ ID NO: 55595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggtcccataatatttacc

SEQ ID NO: 55596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcccataatatttacctag

SEQ ID NO: 55597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccataatatttacctaga

SEQ ID NO: 55598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttacctagaaggaatcact

SEQ ID NO: 55599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaaggaatcactcagata

SEQ ID NO: 55600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaggaatcactcagataa

SEQ ID NO: 55601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaggcatcacttaccaata

SEQ ID NO: 55602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caataaattatctttactct

SEQ ID NO: 55603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctttactctgagccctaa

SEQ ID NO: 55604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaaagatacactgtctat

SEQ ID NO: 55605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acactgtctattagacttga

SEQ ID NO: 55606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtctattagacttgaaagaa

SEQ ID NO: 55607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacttgaaagaatagtcatt

SEQ ID NO: 55608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgaaagaatagtcatttag

SEQ ID NO: 55609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaagaatagtcatttagta

SEQ ID NO: 55610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataaattttaatttttttg

SEQ ID NO: 55611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttaatttttttgtagaaa

SEQ ID NO: 55612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagattttccttttattgcc

SEQ ID NO: 55613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agattttccttttattgccc

SEQ ID NO: 55614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttattgcccaggctgatc

SEQ ID NO: 55615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaggctgatctagaactcc

SEQ ID NO: 55616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatctagaactcctggatc

SEQ ID NO: 55617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctggatcaagcaatcctc

SEQ ID NO: 55618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atcaagcaatcctccagcct

SEQ ID NO: 55619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctccagcctcggcctccca

SEQ ID NO: 55620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcggcctcccaaagtga

SEQ ID NO: 55621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcggcctcccaaagtgat

SEQ ID NO: 55622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgatgggattg

SEQ ID NO: 55623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgatgggattgc

SEQ ID NO: 55624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cccaaagtgatgggattgca

SEQ ID NO: 55625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaaagtgatgggattgcag

SEQ ID NO: 55626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgggattgcaggggtgac

SEQ ID NO: 55627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctgttttactcatctgca

SEQ ID NO: 55628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttcttttttcaaattcta

SEQ ID NO: 55629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttcaaattctaaagta

SEQ ID NO: 55630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctaaagtatagactctc

SEQ ID NO: 55631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaagtatagactctcaag

SEQ ID NO: 55632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatttttaaaataattacat

SEQ ID NO: 55633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acattggatttaaaaacata

SEQ ID NO: 55634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggatttaaaaacatatagtg

SEQ ID NO: 55635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatttaaaaacatatagtgt

SEQ ID NO: 55636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaaaaacatatagtgtag

SEQ ID NO: 55637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatatagtgtaggagcaac

SEQ ID NO: 55638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtgtaggagcaactagtaa

SEQ ID NO: 55639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagcaactagtaaaagttga

SEQ ID NO: 55640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagttgacagataccacatc

SEQ ID NO: 55641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatccagtgaaattacccc

SEQ ID NO: 55642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataatcatcatcatcatcat

SEQ ID NO: 55643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatcatcatcattagataa

SEQ ID NO: 55644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catcatcatcattagataat

SEQ ID NO: 55645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatcattagataatgggct

SEQ ID NO: 55646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
attagataatgggctgagcg

SEQ ID NO: 55647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agataatgggctgagcgcgg

SEQ ID NO: 55648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcatgcttgtaatcc

SEQ ID NO: 55649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcttgtaatcccagcactt

SEQ ID NO: 55650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcttgtaatcccagcacttt

SEQ ID NO: 55651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtaatcccagcactttgg

SEQ ID NO: 55652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagcactttggg

SEQ ID NO: 55653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcactttgggaggtc

SEQ ID NO: 55654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttgggaggtcg

SEQ ID NO: 55655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agcactttgggaggtcgagg

SEQ ID NO: 55656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttgggaggtcgaggc

SEQ ID NO: 55657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctttgggaggtcgaggcggg

SEQ ID NO: 55658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcgaggcgggcggatcac

SEQ ID NO: 55659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcgaggcgggcggatcact

SEQ ID NO: 55660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggcgggcggatcactaggt

SEQ ID NO: 55661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcgggcggatcactaggtc

SEQ ID NO: 55662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggcggatcactaggtcag

SEQ ID NO: 55663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatcactaggtcaggagatt

SEQ ID NO: 55664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagattgagaccatcc

SEQ ID NO: 55665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagaccatcctggctaaca

SEQ ID NO: 55666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactaaaaatacaaaaacat

SEQ ID NO: 55667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaaatacaaaaacattagc

SEQ ID NO: 55668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaatacaaaaacattagcc

SEQ ID NO: 55669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
acaaaaacattagccgggca

SEQ ID NO: 55670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaacattagccgggcacgg

SEQ ID NO: 55671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acattagccgggcacggtgg

SEQ ID NO: 55672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattagccgggcacggtggt

SEQ ID NO: 55673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcacggtggtaggcgcctg

SEQ ID NO: 55674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggtaggcgcctgtagtcc

SEQ ID NO: 55675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cgcctgtagtcccagctact

SEQ ID NO: 55676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgtagtcccagctactcg

SEQ ID NO: 55677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgtagtcccagctactcgg

SEQ ID NO: 55678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcccagctactcggaggct

SEQ ID NO: 55679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccagctactcggaggctg

SEQ ID NO: 55680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagctactcggaggctgagg

SEQ ID NO: 55681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agctactcggaggctgaggc

SEQ ID NO: 55682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctactcggaggctgaggcag

SEQ ID NO: 55683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cggaggctgaggcaggagaa

SEQ ID NO: 55684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggagaatggtgtgaacc

SEQ ID NO: 55685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggagaatggtgtgaaccc

SEQ ID NO: 55686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatggtgtgaacccaggacg

SEQ ID NO: 55687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtgtgaacccaggacgcg

SEQ ID NO: 55688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccaggacgcggagcttg

SEQ ID NO: 55689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggacgcggagcttgcagt

SEQ ID NO: 55690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgcggagcttgcagtgagcc

SEQ ID NO: 55691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatcgcgccactgcactc

SEQ ID NO: 55692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcgccactgcactccagcc

SEQ ID NO: 55693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcgccactgcactccagcct

SEQ ID NO: 55694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcactccagcctgggcga

SEQ ID NO: 55695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgggcgaca

SEQ ID NO: 55696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagcctgggcgacagagc

SEQ ID NO: 55697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaaaaataaaaaaaaaa

SEQ ID NO: 55698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaagaatctttaaaaat

SEQ ID NO: 55699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttaaaaatcagataata

SEQ ID NO: 55700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttaaaaatcagataatac

SEQ ID NO: 55701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttaaaaatcagataataca

SEQ ID NO: 55702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaatcagataatacagg

SEQ ID NO: 55703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcagataatacagggagtc

SEQ ID NO: 55704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcagataatacagggagtct

SEQ ID NO: 55705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agggagtctaggtgtgcata

SEQ ID NO: 55706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatttttattaaaaatctta

SEQ ID NO: 55707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttttattaaaaatcttat

SEQ ID NO: 55708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatcttatttatctttctt

SEQ ID NO: 55709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcttatttatctttcttta

SEQ ID NO: 55710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttatttatctttctttag

SEQ ID NO: 55711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttccaattatttgtactaa

SEQ ID NO: 55712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtactaatagtttgacctaa

SEQ ID NO: 55713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaatagtttgacctaaaag

SEQ ID NO: 55714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatagtttgacctaaaagtg

SEQ ID NO: 55715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggagtaaaatttgccttac

SEQ ID NO: 55716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggcgtacatatcaaacatt

SEQ ID NO: 55717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtacatatcaaacatttgg

SEQ ID NO: 55718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatcaaacatttggaagat

SEQ ID NO: 55719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacatttggaagatgagatg

SEQ ID NO: 55720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatttggaagatgagatgt

SEQ ID NO: 55721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttggaagatgagatgtag

SEQ ID NO: 55722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggaagatgagatgtagga

SEQ ID NO: 55723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagatgagatgtaggagag

SEQ ID NO: 55724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgagatgtaggagagaag

SEQ ID NO: 55725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgagatgtaggagagaaga

SEQ ID NO: 55726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaagaaggaaaaaaaaa

SEQ ID NO: 55727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaggaaaaaaaaaaagaaa

SEQ ID NO: 55728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaaaaaaaaaaagaaaa

SEQ ID NO: 55729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggaaaaaaaaaaagaaaaa

SEQ ID NO: 55730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaaaagggcattcattg

SEQ ID NO: 55731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaaaagggcattcattgc

SEQ ID NO: 55732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaaagggcattcattgca

SEQ ID NO: 55733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagggcattcattgcaggg

SEQ ID NO: 55734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagggcattcattgcagggc

SEQ ID NO: 55735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacactctttctaaatttcc

SEQ ID NO: 55736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttccaagtgaacaatcc

SEQ ID NO: 55737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttccaagtgaacaatcct

SEQ ID NO: 55738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaacaatcctaggtgcaat

SEQ ID NO: 55739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacaatcctaggtgcaatta

SEQ ID NO: 55740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtattttgataaatgatt

SEQ ID NO: 55741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttgataaatgattcaga

SEQ ID NO: 55742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagctttgtaaaaaatcc

SEQ ID NO: 55743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagctttgtaaaaaatcca

SEQ ID NO: 55744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agctttgtaaaaaatccaag

SEQ ID NO: 55745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatccaaggagacatttta

SEQ ID NO: 55746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attttaaagaaatttatgat

SEQ ID NO: 55747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaatttatgatcagtaa

SEQ ID NO: 55748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatttatgatcagtaatag

SEQ ID NO: 55749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctaacacttgacataac

SEQ ID NO: 55750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctaacacttgacataacaa

SEQ ID NO: 55751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaacacttgacataacaag

SEQ ID NO: 55752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaggaaatcataaaatgaa

SEQ ID NO: 55753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaatcataaaatgaatagc

SEQ ID NO: 55754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatcataaaatgaatagca

SEQ ID NO: 55755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgaatagcaaggaaatta

SEQ ID NO: 55756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcaaggaaattacagtta

SEQ ID NO: 55757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattacagttaaagtaacgt

SEQ ID NO: 55758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attacagttaaagtaacgtt

SEQ ID NO: 55759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagtaacgttaggtttcaa

SEQ ID NO: 55760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taggtttcaacagtaatata

SEQ ID NO: 55761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagtaatatatggcatttt

SEQ ID NO: 55762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcactttaaaaaatcta

SEQ ID NO: 55763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactttaaaaaatctaaaga

SEQ ID NO: 55764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagttcatctcctgtgtta

SEQ ID NO: 55765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaacatattttttgctta

SEQ ID NO: 55766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatattttttgcttacagt

SEQ ID NO: 55767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtaagttgttattttaaa

SEQ ID NO: 55768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaagttgttattttaaaaa

SEQ ID NO: 55769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttattttaaaaagagacg

SEQ ID NO: 55770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttaaaaagagacgtgga

SEQ ID NO: 55771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaaagagacgtggaaagaa

SEQ ID NO: 55772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaaagaacggttttctcta

SEQ ID NO: 55773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttttctctatagaactaaa

SEQ ID NO: 55774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctatagaactaaaaagata

SEQ ID NO: 55775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaaagatatagaataatt

SEQ ID NO: 55776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtcaattcaaacttgtctg

SEQ ID NO: 55777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattcaaacttgtctgtgg

SEQ ID NO: 55778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtggcagattatgcttac

SEQ ID NO: 55779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgcttactggcactgttc

SEQ ID NO: 55780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcttactggcactgttca

SEQ ID NO: 55781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttccttccccactttatca

SEQ ID NO: 55782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccccactttatcatggcc

SEQ ID NO: 55783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggcatttttcctcaccacc

SEQ ID NO: 55784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttttcctcaccacccag

SEQ ID NO: 55785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttttcctcaccacccaga

SEQ ID NO: 55786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttttcctcaccacccagaa

SEQ ID NO: 55787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccaaacttcattccacctt

SEQ ID NO: 55788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattccacctttagctgcc

SEQ ID NO: 55789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attccacctttagctgccaa

SEQ ID NO: 55790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttagctgccaagagctga

SEQ ID NO: 55791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggctttttcttttgccta

SEQ ID NO: 55792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcctaaagccatttccttc

SEQ ID NO: 55793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagccatttccttccagc

SEQ ID NO: 55794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagccatttccttccagca

SEQ ID NO: 55795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccatttccttccagcaagg

SEQ ID NO: 55796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catttccttccagcaaggca

SEQ ID NO: 55797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttccttccagcaaggcag

SEQ ID NO: 55798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttccagcaaggcagagga

SEQ ID NO: 55799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttccagcaaggcagaggaa

SEQ ID NO: 55800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttccagcaaggcagaggaaa

SEQ ID NO: 55801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaaggcagaggaaagggt

SEQ ID NO: 55802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaagtgataccttcaatg

SEQ ID NO: 55803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgaagaaatttcattttt

SEQ ID NO: 55804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaatttcattttttagaa

SEQ ID NO: 55805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttcattttttagaatgg

SEQ ID NO: 55806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttcattttttagaatggc

SEQ ID NO: 55807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttatctcatattccacaa

SEQ ID NO: 55808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtattctacccacattctc

SEQ ID NO: 55809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatatgaccttgcctctc

SEQ ID NO: 55810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatgaccttgcctctcaag

SEQ ID NO: 55811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtggtaatctaactctaca

SEQ ID NO: 55812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaactctacacagttcta

SEQ ID NO: 55813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaactctacacagttctaa

SEQ ID NO: 55814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actctacacagttctaaagg

SEQ ID NO: 55815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgtcataatacttctgta

SEQ ID NO: 55816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacttctgtaaagaataaat

SEQ ID NO: 55817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttgtgatgtgtaatatg

SEQ ID NO: 55818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttgtgatgtgtaatatga

SEQ ID NO: 55819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgaaggaccatcttcaat

SEQ ID NO: 55820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaccatcttcaattagtaca

SEQ ID NO: 55821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catccacaatatgtcctctt

SEQ ID NO: 55822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccacaatatgtcctcttca

SEQ ID NO: 55823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaatccctgctcacaat

SEQ ID NO: 55824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacaattagtgaaataatt

SEQ ID NO: 55825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgaaataatttagtccttc

SEQ ID NO: 55826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtccttcaagatgtaatg

SEQ ID NO: 55827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattatttaccaaaaatctg

SEQ ID NO: 55828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttaccaaaaatctgtggc

SEQ ID NO: 55829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacataaaaaaatcattaat

SEQ ID NO: 55830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagtttgtcacctaattga

SEQ ID NO: 55831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattttcaaccaaatgttaa

SEQ ID NO: 55832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaaatgttaatagcaaaac

SEQ ID NO: 55833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgtttgtttaatatcttt

SEQ ID NO: 55834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtttaatatctttaagca

SEQ ID NO: 55835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcatagtctgcaaaaata

SEQ ID NO: 55836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcatagtctgcaaaaataa

SEQ ID NO: 55837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcatagtctgcaaaaataaa

SEQ ID NO: 55838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catagtctgcaaaaataaag

SEQ ID NO: 55839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atagtctgcaaaaataaagg

SEQ ID NO: 55840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagtctgcaaaaataaaggg

SEQ ID NO: 55841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtctgcaaaaataaaggggg

SEQ ID NO: 55842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctgcaaaaataaagggggg

SEQ ID NO: 55843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggaggcaaatcaccataca

SEQ ID NO: 55844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgtgtgtgtgtgtgtgtgt

SEQ ID NO: 55845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgtgtgtgtgtgtgagtgt

SEQ ID NO: 55846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgagtgtgagtgtgtgtg

SEQ ID NO: 55847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtgtgtgtggtaaaattc

SEQ ID NO: 55848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatgacacaatcatttat

SEQ ID NO: 55849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaatcatttatgagcatg

SEQ ID NO: 55850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttatgagcatgaagtttg

SEQ ID NO: 55851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttacttccactctaataa

SEQ ID NO: 55852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccactctaataacagtga

SEQ ID NO: 55853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tccactctaataacagtgat

SEQ ID NO: 55854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataacagtgatgggtcttca

SEQ ID NO: 55855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtgatgggtcttcatggat

SEQ ID NO: 55856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgcctctctgaaccttcct

SEQ ID NO: 55857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcctctctgaaccttcctta

SEQ ID NO: 55858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagagaatgcttcaaatatt

SEQ ID NO: 55859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gataatgtgccctttgtacc

SEQ ID NO: 55860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataatgtgccctttgtacct

SEQ ID NO: 55861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taatgtgccctttgtacctg

SEQ ID NO: 55862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctggggcaaacatcaatt

SEQ ID NO: 55863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacatcaatttagaccgtg

SEQ ID NO: 55864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccgtgtggaaacctaactta

SEQ ID NO: 55865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgactacatttctatcaact

SEQ ID NO: 55866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctatcaactgagctcacat

SEQ ID NO: 55867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatctatgtttattttaa

SEQ ID NO: 55868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaagaatattttaaattca

SEQ ID NO: 55869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatattttaaattcatagt

SEQ ID NO: 55870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catagtcagtgactattgac

SEQ ID NO: 55871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actggccctcaaatttctgt

SEQ ID NO: 55872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatttctgttagatgata

SEQ ID NO: 55873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatacagatttaaacctaac

SEQ ID NO: 55874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atacagatttaaacctaaca

SEQ ID NO: 55875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctaacaaggttatcattt

SEQ ID NO: 55876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaggttatcattttagatt

SEQ ID NO: 55877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggttatcattttagatttg

SEQ ID NO: 55878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggagtcacttataaccatat

SEQ ID NO: 55879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatattttaatacatttg

SEQ ID NO: 55880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtggtcactgcctttct

SEQ ID NO: 55881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attacaaattacttaccttt

SEQ ID NO: 55882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatcacctacactgataa

SEQ ID NO: 55883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcacctacactgataaaa

SEQ ID NO: 55884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacctacactgataaaaga

SEQ ID NO: 55885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaaagagagaatacatct

SEQ ID NO: 55886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaagagagaatacatctc

SEQ ID NO: 55887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgcttgacaaataaaaaa

SEQ ID NO: 55888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcacaaaattcatgtttc

SEQ ID NO: 55889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcacaaaattcatgtttcc

SEQ ID NO: 55890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcacaaaattcatgtttcca

SEQ ID NO: 55891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agggttaatatgctttattc

SEQ ID NO: 55892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttaatatgctttattctgg

SEQ ID NO: 55893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaccccctactacttgatgc

SEQ ID NO: 55894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accccctactacttgatgcc

SEQ ID NO: 55895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttgatgccaggcactattc

SEQ ID NO: 55896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgccaggcactattctgg

SEQ ID NO: 55897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggcactattctggaagct

SEQ ID NO: 55898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaagctaagtcaacaatg

SEQ ID NO: 55899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaagtcaacaatgaagaca

SEQ ID NO: 55900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaacaatgaagacatagtc

SEQ ID NO: 55901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caacaatgaagacatagtct

SEQ ID NO: 55902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agacatagtctgggttccct

SEQ ID NO: 55903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acatagtctgggttcccttg

SEQ ID NO: 55904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgggttcccttggagtatt

SEQ ID NO: 55905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatacctgcatgctgtaac

SEQ ID NO: 55906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacctgcatgctgtaacaag

SEQ ID NO: 55907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctgtaacaagcagtatga

SEQ ID NO: 55908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaagcagtatgaaagaaac

SEQ ID NO: 55909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagcagtatgaaagaaaca

SEQ ID NO: 55910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaacaaggttccaacatc

SEQ ID NO: 55911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttccaacatcaagaccaaca

SEQ ID NO: 55912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tccaacatcaagaccaacac

SEQ ID NO: 55913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgggacaacctacttttaac

SEQ ID NO: 55914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttccaaaacaaaaaaacctc

SEQ ID NO: 55915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaacaaaaaaacctcgagtt

SEQ ID NO: 55916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacctcgagttgagattta

SEQ ID NO: 55917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgagttgagatttaaagttt

SEQ ID NO: 55918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgagatttaaagtttaag

SEQ ID NO: 55919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgagatttaaagtttaaga

SEQ ID NO: 55920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagatttaaagtttaagaag

SEQ ID NO: 55921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaagtttaagaaggagt

SEQ ID NO: 55922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagaaggagtaagcacgca

SEQ ID NO: 55923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaggagtaagcacgcata

SEQ ID NO: 55924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagtaagcacgcatagagtt

SEQ ID NO: 55925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtaagcacgcatagagttc

SEQ ID NO: 55926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacgcatagagttcaggcat

SEQ ID NO: 55927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acgcatagagttcaggcatt

SEQ ID NO: 55928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagagttcaggcattgggaa

SEQ ID NO: 55929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattgggaacagcatttgaa

SEQ ID NO: 55930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgggaacagcatttgaaa

SEQ ID NO: 55931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcatttgaaaaggcctta

SEQ ID NO: 55932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatttgaaaaggccttaaa

SEQ ID NO: 55933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctattgtttcatgtgttt

SEQ ID NO: 55934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgtgttttagccacgacc

SEQ ID NO: 55935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgtgttttagccacgacct

SEQ ID NO: 55936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttttagccacgacctggg

SEQ ID NO: 55937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttttagccacgacctgggc

SEQ ID NO: 55938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagccacgacctgggcag

SEQ ID NO: 55939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgggcaggagcaccttaat

SEQ ID NO: 55940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaggagcaccttaatgag

SEQ ID NO: 55941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggagcaccttaatgagaa

SEQ ID NO: 55942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaccttaatgagaagagaa

SEQ ID NO: 55943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caccttaatgagaagagaat

SEQ ID NO: 55944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgagaagagaataggttc

SEQ ID NO: 55945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagagaataggttctggt

SEQ ID NO: 55946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagagaataggttctggtg

SEQ ID NO: 55947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaataggttctggtgaggt

SEQ ID NO: 55948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataggttctggtgaggttg

SEQ ID NO: 55949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggttctggtgaggttgga

SEQ ID NO: 55950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttctggtgaggttggagag

SEQ ID NO: 55951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctggtgaggttggagaga

SEQ ID NO: 55952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctggtgaggttggagagaa

SEQ ID NO: 55953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgaggttggagagaaggga

SEQ ID NO: 55954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttggagagaagggacagaa

SEQ ID NO: 55955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggagagaagggacagaaca

SEQ ID NO: 55956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagagaagggacagaacaga

SEQ ID NO: 55957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagagagtaaaccatatgct

SEQ ID NO: 55958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagagtaaaccatatgctg

SEQ ID NO: 55959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaaaccatatgctgagga

SEQ ID NO: 55960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaaaccatatgctgaggaa

SEQ ID NO: 55961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catttactgttgttgctaat

SEQ ID NO: 55962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttttttttttttaaatg

SEQ ID NO: 55963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttttttaaatgcagttgt

SEQ ID NO: 55964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttgtgagccaatgtttgt

SEQ ID NO: 55965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgtgagccaatgtttgtt

SEQ ID NO: 55966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtgagccaatgtttgtta

SEQ ID NO: 55967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtgagccaatgtttgttag

SEQ ID NO: 55968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagccaatgtttgttaggg

SEQ ID NO: 55969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaatgtttgttaggggaga

SEQ ID NO: 55970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatgtttgttaggggagac

SEQ ID NO: 55971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttgttaggggagacagga

SEQ ID NO: 55972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggatggtattgctttgta

SEQ ID NO: 55973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggatggtattgctttgtata

SEQ ID NO: 55974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgtatagagaatgaattg

SEQ ID NO: 55975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtatagagaatgaattgc

SEQ ID NO: 55976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtatagagaatgaattgca

SEQ ID NO: 55977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtatagagaatgaattgcag

SEQ ID NO: 55978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagagaatgaattgcaggg

SEQ ID NO: 55979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattgcaggggagaaaatta

SEQ ID NO: 55980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaggggagaaaattacag

SEQ ID NO: 55981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggggagaaaattacagaag

SEQ ID NO: 55982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggagaaaattacagaagtg

SEQ ID NO: 55983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagaaaattacagaagtgga

SEQ ID NO: 55984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagaagtggagagattgata

SEQ ID NO: 55985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagtggagagattgatatg

SEQ ID NO: 55986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtggagagattgatatgg

SEQ ID NO: 55987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagattgatatggaggctg

SEQ ID NO: 55988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattgatatggaggctgtgg

SEQ ID NO: 55989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgatatggaggctgtggc

SEQ ID NO: 55990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaggctgtggcaggattcc

SEQ ID NO: 55991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatgatgacctgaactaatt

SEQ ID NO: 55992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatgacctgaactaatttgg

SEQ ID NO: 55993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaactaatttggtggccgtg

SEQ ID NO: 55994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttggtggccgtgtagata

SEQ ID NO: 55995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggccgtgtagatacagaa

SEQ ID NO: 55996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggccgtgtagatacagaaaa

SEQ ID NO: 55997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccgtgtagatacagaaaag

SEQ ID NO: 55998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccgtgtagatacagaaaaga

SEQ ID NO: 55999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atacagaaaagagggtgaat

SEQ ID NO: 56000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagaaaagagggtgaatga

SEQ ID NO: 56001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagaaaagagggtgaatgag

SEQ ID NO: 56002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggtgaatgagaggcatct

SEQ ID NO: 56003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctgagacgtatgatgaaa

SEQ ID NO: 56004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acgtatgatgaaatagaaat

SEQ ID NO: 56005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatgaaatagaaataagtt

SEQ ID NO: 56006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatgaaatagaaataagttt

SEQ ID NO: 56007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaaatagaaataagtttgg

SEQ ID NO: 56008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaaataagtttgggagat

SEQ ID NO: 56009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtttgggagataagattga

SEQ ID NO: 56010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagattgatagatctactta

SEQ ID NO: 56011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agattgatagatctacttac

SEQ ID NO: 56012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatagatctacttacaggc

SEQ ID NO: 56013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatctacttacaggctgga

SEQ ID NO: 56014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatctacttacaggctggaa

SEQ ID NO: 56015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atctacttacaggctggaaa

SEQ ID NO: 56016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggctggaaagggctgaaa

SEQ ID NO: 56017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggctggaaagggctgaaatg

SEQ ID NO: 56018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagggctgaaatggagtaat

SEQ ID NO: 56019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggctgaaatggagtaata

SEQ ID NO: 56020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctgaaatggagtaataagg

SEQ ID NO: 56021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaaatggagtaataaggaa

SEQ ID NO: 56022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatggagtaataaggaaga

SEQ ID NO: 56023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaggaagagagcaatca

SEQ ID NO: 56024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaggaagagagcaatcaa

SEQ ID NO: 56025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaaaggtgatttcaatact

SEQ ID NO: 56026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggtgatttcaatacttgga

SEQ ID NO: 56027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttcaatacttggatggtg

SEQ ID NO: 56028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcaatacttggatggtga

SEQ ID NO: 56029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggatggtgaaggcatttatt

SEQ ID NO: 56030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcatttattcagataatg

SEQ ID NO: 56031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttattcagataatgaaga

SEQ ID NO: 56032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttattcagataatgaagat

SEQ ID NO: 56033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattcagataatgaagatgg

SEQ ID NO: 56034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcagataatgaagatggg

SEQ ID NO: 56035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agataatgaagatgggagga

SEQ ID NO: 56036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatgggaggaaagaatct

SEQ ID NO: 56037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggaggaaagaatctgaga

SEQ ID NO: 56038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaggaaagaatctgagaca

SEQ ID NO: 56039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaatctgagacagagttt

SEQ ID NO: 56040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaatctgagacagagtttt

SEQ ID NO: 56041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaatctgagacagagtttta

SEQ ID NO: 56042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgagacagagttttaggga

SEQ ID NO: 56043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attattatcattatgacatc

SEQ ID NO: 56044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttacatcaataaacttt

SEQ ID NO: 56045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaactttaagctcttttac

SEQ ID NO: 56046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaagatcatgacttgtct

SEQ ID NO: 56047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcatgacttgtcttagaa

SEQ ID NO: 56048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtaccatataaatccttc

SEQ ID NO: 56049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acactcttttgcataactaa

SEQ ID NO: 56050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactcttttgcataactaat

SEQ ID NO: 56051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgcataactaataggaa

SEQ ID NO: 56052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taactaataggaatagaaat

SEQ ID NO: 56053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagaaattggataaaaaa

SEQ ID NO: 56054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctacttttttccttgcca

SEQ ID NO: 56055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctacttttttccttgccaca

SEQ ID NO: 56056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttccttgccacagaga

SEQ ID NO: 56057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttccttgccacagagaaag

SEQ ID NO: 56058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttccttgccacagagaaagt

SEQ ID NO: 56059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttgattatattaaataaa

SEQ ID NO: 56060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctattttgcttctgaaact

SEQ ID NO: 56061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgcttctgaaactcagca

SEQ ID NO: 56062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgaaactcagcacagcaa

SEQ ID NO: 56063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgaaactcagcacagcaac

SEQ ID NO: 56064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaactcagcacagcaacagg

SEQ ID NO: 56065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcaacaggtagtaaaaaca

SEQ ID NO: 56066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaggtagtaaaaacatag

SEQ ID NO: 56067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacatagaagcattacca

SEQ ID NO: 56068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatagaagcattaccacag

SEQ ID NO: 56069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catagaagcattaccacaga

SEQ ID NO: 56070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atagaagcattaccacagaa

SEQ ID NO: 56071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agggctcccatgattatatg

SEQ ID NO: 56072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggctcccatgattatatgc

SEQ ID NO: 56073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccatgattatatgcaggccc

SEQ ID NO: 56074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgattatatgcaggccct

SEQ ID NO: 56075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgattatatgcaggcccta

SEQ ID NO: 56076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgattatatgcaggccctag

SEQ ID NO: 56077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatgcaggccctagggga

SEQ ID NO: 56078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatgcaggccctaggggaa

SEQ ID NO: 56079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcaggccctaggggaaag

SEQ ID NO: 56080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcaggccctaggggaaagg

SEQ ID NO: 56081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctaggggaaaggaggccc

SEQ ID NO: 56082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggaggcccaagatgcttt

SEQ ID NO: 56083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaggcccaagatgcttttgg

SEQ ID NO: 56084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcccaagatgcttttggca

SEQ ID NO: 56085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccaagatgcttttggcaga

SEQ ID NO: 56086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgcttttggcagagagc

SEQ ID NO: 56087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgactcatctttcttctg

SEQ ID NO: 56088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactcatctttcttctgtag

SEQ ID NO: 56089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttcttctgtagaagcat

SEQ ID NO: 56090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttcttctgtagaagcatc

SEQ ID NO: 56091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagcatcaggtactctgt

SEQ ID NO: 56092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcaggtactctgtgagcc

SEQ ID NO: 56093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgagcctagccctgcacca

SEQ ID NO: 56094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagcctagccctgcaccat

SEQ ID NO: 56095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccctgcaccataggaatc

SEQ ID NO: 56096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccctgcaccataggaatca

SEQ ID NO: 56097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaaggcatatcatatatc

SEQ ID NO: 56098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactgtaaaaacacatcact

SEQ ID NO: 56099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactgagtcccacaactgca

SEQ ID NO: 56100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagtcccacaactgcacag

SEQ ID NO: 56101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactgcacagtggcttactt

SEQ ID NO: 56102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgcacagtggcttactta

SEQ ID NO: 56103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttaaaaaacttgtctt

SEQ ID NO: 56104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgtcttaagccaaactat

SEQ ID NO: 56105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaactatcagttgcctaaa

SEQ ID NO: 56106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactatcagttgcctaaata

SEQ ID NO: 56107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actatcagttgcctaaatag

SEQ ID NO: 56108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctatcagttgcctaaataga

SEQ ID NO: 56109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcaaataccatattctgtc

SEQ ID NO: 56110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaataccatattctgtcta

SEQ ID NO: 56111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctagagttttgttgttgat

SEQ ID NO: 56112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagttttgttgttgataagc

SEQ ID NO: 56113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcatgaaaatttgcgaca

SEQ ID NO: 56114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcatgaaaatttgcgacac

SEQ ID NO: 56115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcatgaaaatttgcgacaca

SEQ ID NO: 56116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaatttgcgacacagggat

SEQ ID NO: 56117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcgacacagggatcagat

SEQ ID NO: 56118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acacagggatcagataagac

SEQ ID NO: 56119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatctcaccataattat

SEQ ID NO: 56120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattataaacttttttaaa

SEQ ID NO: 56121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttataaacttttttaaatag

SEQ ID NO: 56122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatagtggaaaaaatctg

SEQ ID NO: 56123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaatttgcaataaaatgaa

SEQ ID NO: 56124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatgaacagtttaataat

SEQ ID NO: 56125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacagtttaataattggatt

SEQ ID NO: 56126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taataattggatttggtttg

SEQ ID NO: 56127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtttgcagtttatataaaa

SEQ ID NO: 56128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttgcagtttatataaaat

SEQ ID NO: 56129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataggtttatattgatgtta

SEQ ID NO: 56130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaatatatttaaataac

SEQ ID NO: 56131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaatatatttaaataaca

SEQ ID NO: 56132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatatttaaataacaagga

SEQ ID NO: 56133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttaaataacaaggaaaga

SEQ ID NO: 56134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaataacaaggaaagaaa

SEQ ID NO: 56135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataacaaggaaagaaagaga

SEQ ID NO: 56136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaatctttatcttgtcta

SEQ ID NO: 56137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatctttatcttgtctac

SEQ ID NO: 56138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatctttatcttgtctaca

SEQ ID NO: 56139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctttatcttgtctacaggg

SEQ ID NO: 56140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcttgtctacagggaag

SEQ ID NO: 56141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtctacagggaagaagaaa

SEQ ID NO: 56142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagggaagaagaaatagaa

SEQ ID NO: 56143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataataaatatgtttctgaa

SEQ ID NO: 56144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccaacactgacttcctatt

SEQ ID NO: 56145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcctattcagtaactgac

SEQ ID NO: 56146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaagctatcacttccttga

SEQ ID NO: 56147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttgaaagcttactttgatt

SEQ ID NO: 56148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcttttatcttactgacac

SEQ ID NO: 56149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcttcttaaaaacccccct

SEQ ID NO: 56150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtaaattgctcttaacat

SEQ ID NO: 56151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaaattgctcttaacatca

SEQ ID NO: 56152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattgctcttaacatcagag

SEQ ID NO: 56153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaaaaactaaaataat

SEQ ID NO: 56154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttactataatcacaaaaac

SEQ ID NO: 56155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaactggcattaatgtttc

SEQ ID NO: 56156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgatttttgtcttgaatat

SEQ ID NO: 56157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatttttgtcttgaatata

SEQ ID NO: 56158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatatccattttttcctaa

SEQ ID NO: 56159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttttcctaaaagtaaat

SEQ ID NO: 56160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagtaaatgagtttccc

SEQ ID NO: 56161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccaagttgaattcgataaa

SEQ ID NO: 56162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaattcgataaaaagttaa

SEQ ID NO: 56163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaattcgataaaaagttaaa

SEQ ID NO: 56164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttctgaatttcactata

SEQ ID NO: 56165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataaataaataatctgcgct

SEQ ID NO: 56166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaataatctgcgctgagaaa

SEQ ID NO: 56167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataatctgcgctgagaaat

SEQ ID NO: 56168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataatctgcgctgagaaata

SEQ ID NO: 56169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taatctgcgctgagaaatag

SEQ ID NO: 56170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgcgctgagaaatagggg

SEQ ID NO: 56171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcgctgagaaataggggca

SEQ ID NO: 56172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttgtgtttgtgtgctctt

SEQ ID NO: 56173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtgtttgtgtgctctta

SEQ ID NO: 56174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtgtttgtgtgctcttaa

SEQ ID NO: 56175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtgtttgtgtgctcttaag

SEQ ID NO: 56176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttgtgtgctcttaaggggtg

SEQ ID NO: 56177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtgtgctcttaaggggtgc

SEQ ID NO: 56178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgtgctcttaaggggtgcg

SEQ ID NO: 56179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggttcttttctgtcccca

SEQ ID NO: 56180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggttcttttctgtccccac

SEQ ID NO: 56181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccccacaggttgtatctgct

SEQ ID NO: 56182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaggttgtatctgctaagc

SEQ ID NO: 56183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaagctggttctgcacgct

SEQ ID NO: 56184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttctgcacgctcagctttg

SEQ ID NO: 56185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcacgctcagctttgcaga

SEQ ID NO: 56186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcacgctcagctttgcagat

SEQ ID NO: 56187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctttgcagatgggaaata

SEQ ID NO: 56188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttgctcgtaaaaaatgt

SEQ ID NO: 56189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgagctgccccttgaattg

SEQ ID NO: 56190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtccatctaacaactctgc

SEQ ID NO: 56191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaactctgctagcgtaaa

SEQ ID NO: 56192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctagcgtaaacagaaataa

SEQ ID NO: 56193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcgtaaacagaaataaaaga

SEQ ID NO: 56194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataaaagacagtaaaccac

SEQ ID NO: 56195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaaagacagtaaaccacc

SEQ ID NO: 56196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgctacccttcctttcca

SEQ ID NO: 56197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccttcctttccacagttt

SEQ ID NO: 56198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttccacagtttcagaacc

SEQ ID NO: 56199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccacagtttcagaacctgg

SEQ ID NO: 56200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaacctggcagcaaaccca

SEQ ID NO: 56201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacctggcagcaaacccaca

SEQ ID NO: 56202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccacagagtcaaaaccgca

SEQ ID NO: 56203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccacagagtcaaaaccgcac

SEQ ID NO: 56204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagagtcaaaaccgcacag

SEQ ID NO: 56205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaccgcacaggagctgcc

SEQ ID NO: 56206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatcgaaataactacgcttc

SEQ ID NO: 56207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcccttcttcctcccattgc

SEQ ID NO: 56208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctcccattgctggaaccacc

SEQ ID NO: 56209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgctggaaccacccggtc

SEQ ID NO: 56210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttctcccctctcttctttc

SEQ ID NO: 56211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctcccctctcttctttcc

SEQ ID NO: 56212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcccctctcttctttccagg

SEQ ID NO: 56213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttccaggtggcgtaata

SEQ ID NO: 56214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttccaggtggcgtaatac

SEQ ID NO: 56215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttccaggtggcgtaataca

SEQ ID NO: 56216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtggcgtaatacagggttc

SEQ ID NO: 56217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatacagggttccagaacc

SEQ ID NO: 56218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagaaccgagatgtgaaaa

SEQ ID NO: 56219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccgagatgtgaaaatagaca

SEQ ID NO: 56220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgagatgtgaaaatagacac

SEQ ID NO: 56221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatgtgaaaatagacacagg

SEQ ID NO: 56222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgtgaaaatagacacaggt

SEQ ID NO: 56223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatagacacaggtgggtg

SEQ ID NO: 56224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atagacacaggtgggtgtgg

SEQ ID NO: 56225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacaggtgggtgtggcggtt

SEQ ID NO: 56226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaggtgggtgtggcggttg

SEQ ID NO: 56227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgggtgtggcggttgaggc

SEQ ID NO: 56228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgtggcggttgaggcgagca

SEQ ID NO: 56229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtggcggttgaggcgagcac

SEQ ID NO: 56230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgaggcgagcacgggcga

SEQ ID NO: 56231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcgagcacgggcgaaagacc

SEQ ID NO: 56232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgagcacgggcgaaagaccg

SEQ ID NO: 56233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagcacgggcgaaagaccga

SEQ ID NO: 56234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcttctcctcccctcccca

SEQ ID NO: 56235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcctcccctccccacag

SEQ ID NO: 56236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctcccctccccacagaag

SEQ ID NO: 56237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctccccacagaagcagcaa

SEQ ID NO: 56238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacagaagcagcaaaagaa

SEQ ID NO: 56239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacagaagcagcaaaagaaa

SEQ ID NO: 56240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaggcacttacttgcaacc

SEQ ID NO: 56241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcccgccgatcatccccacc

SEQ ID NO: 56242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccccacccagtgcacctg

SEQ ID NO: 56243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccagtgcacctgcagaatc

SEQ ID NO: 56244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacctgcagaatctggctc

SEQ ID NO: 56245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacctgcagaatctggctcc

SEQ ID NO: 56246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgcagaatctggctccag

SEQ ID NO: 56247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcagaatctggctccagga

SEQ ID NO: 56248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagaatctggctccaggag

SEQ ID NO: 56249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagaatctggctccaggaga

SEQ ID NO: 56250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tctggctccaggagagggcg

SEQ ID NO: 56251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggctccaggagagggcgc

SEQ ID NO: 56252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggcgcgggcctctccttccc

SEQ ID NO: 56253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccttccccggcgctctct

SEQ ID NO: 56254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccttccccggcgctctctc

SEQ ID NO: 56255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttccccggcgctctctca

SEQ ID NO: 56256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagggctgcttctttttctc

SEQ ID NO: 56257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggctgcttctttttctct

SEQ ID NO: 56258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctctgggctcctgttgct

SEQ ID NO: 56259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctgggctcctgttgctc

SEQ ID NO: 56260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctgggctcctgttgctca

SEQ ID NO: 56261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctgggctcctgttgctcag

SEQ ID NO: 56262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctcaggggacgcctgccgc

SEQ ID NO: 56263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggggacgcctgccgctag

SEQ ID NO: 56264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctgccgctagcagccac

SEQ ID NO: 56265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgctagcagccactggcacc

SEQ ID NO: 56266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctagcagccactggcaccc

SEQ ID NO: 56267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagccactggcacccaggc

SEQ ID NO: 56268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactggcacccaggctagcc

SEQ ID NO: 56269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacccaggctagcccagcct

SEQ ID NO: 56270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggctagcccagcctcagcc

SEQ ID NO: 56271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagcccagcctcagccgagc

SEQ ID NO: 56272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cccagcctcagccgagctgg

SEQ ID NO: 56273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcagccgagctggcggaat

SEQ ID NO: 56274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccgagctggcggaattgga

SEQ ID NO: 56275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggcggaattggaaagccga

SEQ ID NO: 56276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaagccgacagccgccgc

SEQ ID NO: 56277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagccgacagccgccgctg

SEQ ID NO: 56278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacagccgccgctggagcgc

SEQ ID NO: 56279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagcgctggcgaccgcctgc

SEQ ID NO: 56280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgctggcgaccgcctgcaag

SEQ ID NO: 56281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagactgcgcccctcctgc

SEQ ID NO: 56282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagactgcgcccctcctgcc

SEQ ID NO: 56283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agactgcgcccctcctgcca

SEQ ID NO: 56284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcctgccagggcgcgcccg

SEQ ID NO: 56285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgccagggcgcgcccgtg

SEQ ID NO: 56286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgccagggcgcgcccgtgg

SEQ ID NO: 56287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagggcgcgcccgtggagg

SEQ ID NO: 56288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggcgcgcccgtggaggtag

SEQ ID NO: 56289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtagcagccccgcctcccc

SEQ ID NO: 56290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtagcagccccgcctccccg

SEQ ID NO: 56291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagcagccccgcctccccga

SEQ ID NO: 56292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagccccgcctccccgaggg

SEQ ID NO: 56293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgcctcctccactcctcc

SEQ ID NO: 56294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tccactcctcccagcgcgcc

SEQ ID NO: 56295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccactcctcccagcgcgccc

SEQ ID NO: 56296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cctccctctctccactcctg

SEQ ID NO: 56297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctccctctctccactcctgc

SEQ ID NO: 56298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cctctctccactcctgcggg

SEQ ID NO: 56299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccactcctgcgggcggcg

SEQ ID NO: 56300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccactcctgcgggcggcgc

SEQ ID NO: 56301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccactcctgcgggcggcgca

SEQ ID NO: 56302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctcctgcgggcggcgcaggg

SEQ ID NO: 56303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctgcgggcggcgcagggc

SEQ ID NO: 56304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctgcgggcggcgcagggcg

SEQ ID NO: 56305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcggcgcagggcggggacc

SEQ ID NO: 56306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcgcagggcggggacccagc

SEQ ID NO: 56307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgcagggcggggacccagct

SEQ ID NO: 56308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcagggcggggacccagcta

SEQ ID NO: 56309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagggcggggacccagctag

SEQ ID NO: 56310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cggggacccagctaggggcg

SEQ ID NO: 56311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggacccagctaggggcgcgg

SEQ ID NO: 56312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccagctaggggcgcggtgg

SEQ ID NO: 56313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcgcggtggtggcgacgctg

SEQ ID NO: 56314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctctgcaccatgcgctaa

SEQ ID NO: 56315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgcaccatgcgctaatag

SEQ ID NO: 56316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgcaccatgcgctaataga

SEQ ID NO: 56317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caccatgcgctaatagaagg

SEQ ID NO: 56318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccatgcgctaatagaaggcg

SEQ ID NO: 56319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgcgctaatagaaggcgg

SEQ ID NO: 56320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcgctaatagaaggcggag

SEQ ID NO: 56321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcgctaatagaaggcggagg

SEQ ID NO: 56322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgctaatagaaggcggagga

SEQ ID NO: 56323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctaatagaaggcggaggag

SEQ ID NO: 56324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaatagaaggcggaggagg

SEQ ID NO: 56325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gttgcacgacctgccatcca

SEQ ID NO: 56326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgccatccacggccacccat

SEQ ID NO: 56327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccatccacggccacccatt

SEQ ID NO: 56328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atccacggccacccattggg

SEQ ID NO: 56329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tccacggccacccattgggt

SEQ ID NO: 56330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccacggccacccattgggtg

SEQ ID NO: 56331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtggggcgtgtgtgtgttt

SEQ ID NO: 56332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgtgtgtgtgtgtgtgtc

SEQ ID NO: 56333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgtgtgtgtgtgtgtccag

SEQ ID NO: 56334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgtgtgtgtgtccagcagc

SEQ ID NO: 56335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgtgtgtccagcagccag

SEQ ID NO: 56336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgtgtccagcagccagaa

SEQ ID NO: 56337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccctttcctcccttcctgct

SEQ ID NO: 56338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttcctcccttcctgctcag

SEQ ID NO: 56339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cccttcctgctcagcagaat

SEQ ID NO: 56340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagaatcggctaatgtttcc

SEQ ID NO: 56341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcggctaatgtttccgag

SEQ ID NO: 56342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccgagaagtcactttgtg

SEQ ID NO: 56343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaagtcactttgtgtggct

SEQ ID NO: 56344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcactttgtgtggcttgg

SEQ ID NO: 56345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtcactttgtgtggcttggt

SEQ ID NO: 56346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcactttgtgtggcttggtg

SEQ ID NO: 56347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actttgtgtggcttggtggg

SEQ ID NO: 56348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgtggcttggtggggagc

SEQ ID NO: 56349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtggcttggtggggagctg

SEQ ID NO: 56350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggggagctggagaaaaactc

SEQ ID NO: 56351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagctggagaaaaactccg

SEQ ID NO: 56352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctggagaaaaactccggag

SEQ ID NO: 56353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggagaaaaactccggagca

SEQ ID NO: 56354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagaaaaactccggagcag

SEQ ID NO: 56355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaaactccggagcagag

SEQ ID NO: 56356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaaactccggagcagagg

SEQ ID NO: 56357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactccggagcagaggagg

SEQ ID NO: 56358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactccggagcagaggaggt

SEQ ID NO: 56359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actccggagcagaggaggtg

SEQ ID NO: 56360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagaggaggtggggaccaa

SEQ ID NO: 56361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaggtggggaccaatggca

SEQ ID NO: 56362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggaccaatggcaaagccct

SEQ ID NO: 56363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatggcaaagccctgagtc

SEQ ID NO: 56364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatggcaaagccctgagtct

SEQ ID NO: 56365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atggcaaagccctgagtctg

SEQ ID NO: 56366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaaagccctgagtctgggg

SEQ ID NO: 56367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagccctgagtctggggcag

SEQ ID NO: 56368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctgagtctggggcagtggc

SEQ ID NO: 56369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgagtctggggcagtggct

SEQ ID NO: 56370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagtctggggcagtggctg

SEQ ID NO: 56371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtctggggcagtggctggg

SEQ ID NO: 56372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggcagtggctggggagc

SEQ ID NO: 56373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggagccagacaacaccgc

SEQ ID NO: 56374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggagccagacaacaccgcc

SEQ ID NO: 56375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccagacaacaccgccaggc

SEQ ID NO: 56376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggccagcgcctccccgacct

SEQ ID NO: 56377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccagcgcctccccgacctt

SEQ ID NO: 56378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccccgaccttgggctctg

SEQ ID NO: 56379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccccgaccttgggctctgaa

SEQ ID NO: 56380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accttgggctctgaagagtc

SEQ ID NO: 56381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttgggctctgaagagtct

SEQ ID NO: 56382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggctctgaagagtctaggc

SEQ ID NO: 56383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggctctgaagagtctaggct

SEQ ID NO: 56384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagagtctaggctgggaat

SEQ ID NO: 56385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgggaattggtttcttccg

SEQ ID NO: 56386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggaattggtttcttccgt

SEQ ID NO: 56387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggaattggtttcttccgta

SEQ ID NO: 56388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggctttgctcacaaccgc

SEQ ID NO: 56389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctttgctcacaaccgcgag

SEQ ID NO: 56390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttgctcacaaccgcgagt

SEQ ID NO: 56391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgctcacaaccgcgagtg

SEQ ID NO: 56392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gctcacaaccgcgagtgggg

SEQ ID NO: 56393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgagtggggcggtgacgctc

SEQ ID NO: 56394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggggcggtgacgctcaagac

SEQ ID NO: 56395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacgctcaagaccggtatc

SEQ ID NO: 56396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacgctcaagaccggtatct

SEQ ID NO: 56397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataaaatcaattgaattg

SEQ ID NO: 56398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattgaattgcagcgtcttc

SEQ ID NO: 56399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgaattgcagcgtcttcc

SEQ ID NO: 56400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgcagcgtcttccaggc

SEQ ID NO: 56401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataatacattttctttcg

SEQ ID NO: 56402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacattttctttcgaagatg

SEQ ID NO: 56403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctttcgaagatgcagtg

SEQ ID NO: 56404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcgaagatgcagtgaagaat

SEQ ID NO: 56405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagatgcagtgaagaatca

SEQ ID NO: 56406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagatgcagtgaagaatcag

SEQ ID NO: 56407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgcagtgaagaatcagag

SEQ ID NO: 56408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcagtgaagaatcagagg

SEQ ID NO: 56409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaagaatcagaggaggtcc

SEQ ID NO: 56410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagaatcagaggaggtcct

SEQ ID NO: 56411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatcagaggaggtcctagg

SEQ ID NO: 56412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcagaggaggtcctaggt

SEQ ID NO: 56413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcagaggaggtcctaggtg

SEQ ID NO: 56414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggaggtcctaggtgggga

SEQ ID NO: 56415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctaggtggggaaagaaacg

SEQ ID NO: 56416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaggtggggaaagaaacgt

SEQ ID NO: 56417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggtggggaaagaaacgtg

SEQ ID NO: 56418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggggaaagaaacgtggggaa

SEQ ID NO: 56419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggaaagaaacgtggggaaa

SEQ ID NO: 56420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggaaaaggctgcttttc

SEQ ID NO: 56421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaggctgcttttccagacc

SEQ ID NO: 56422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggctgcttttccagacct

SEQ ID NO: 56423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgattatctgaatatgccat

SEQ ID NO: 56424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaatatgccatcagtcata

SEQ ID NO: 56425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaatatgccatcagtcatat

SEQ ID NO: 56426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcatatgggttctgaattt

SEQ ID NO: 56427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catatgggttctgaatttca

SEQ ID NO: 56428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggttctgaatttcagagc

SEQ ID NO: 56429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttctgaatttcagagctgg

SEQ ID NO: 56430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctgaatttcagagctggt

SEQ ID NO: 56431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaatttcagagctggtag

SEQ ID NO: 56432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttaaaaattcattttgtg

SEQ ID NO: 56433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaaaattcattttgtgtg

SEQ ID NO: 56434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgtgcgtgcgctttccta

SEQ ID NO: 56435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgcgtgcgctttcctacag

SEQ ID NO: 56436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcgctttcctacagcagcc

SEQ ID NO: 56437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcgctttcctacagcagcct

SEQ ID NO: 56438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctttcctacagcagcctgg

SEQ ID NO: 56439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttcctacagcagcctggg

SEQ ID NO: 56440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctacagcagcctgggagg

SEQ ID NO: 56441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagcctgggaggaagaacaa

SEQ ID NO: 56442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggaggaagaacaatggaaa

SEQ ID NO: 56443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaggaagaacaatggaaac

SEQ ID NO: 56444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaggaagaacaatggaaaca

SEQ ID NO: 56445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggttgaattatctttctca

SEQ ID NO: 56446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttgaattatctttctcaaa

SEQ ID NO: 56447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatctttctcaaagagaaa

SEQ ID NO: 56448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatctttctcaaagagaaac

SEQ ID NO: 56449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaacaggaaatttccacc

SEQ ID NO: 56450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaacaggaaatttccacca

SEQ ID NO: 56451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaggaaatttccaccaa

SEQ ID NO: 56452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggaaatttccaccaaggg

SEQ ID NO: 56453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaccaagggaagaaatca

SEQ ID NO: 56454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaccaagggaagaaatcaa

SEQ ID NO: 56455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagggaagaaatcaaagga

SEQ ID NO: 56456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaatcaaaggatggcca

SEQ ID NO: 56457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaatcaaaggatggccat

SEQ ID NO: 56458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaatcaaaggatggccata

SEQ ID NO: 56459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaaaggatggccataggg

SEQ ID NO: 56460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaaggatggccatagggc

SEQ ID NO: 56461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaggatggccatagggca

SEQ ID NO: 56462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagggcagggtgcctctcaa

SEQ ID NO: 56463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggcagggtgcctctcaaa

SEQ ID NO: 56464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggcagggtgcctctcaaaa

SEQ ID NO: 56465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagggtgcctctcaaaaggg

SEQ ID NO: 56466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaagggcagaccactttg

SEQ ID NO: 56467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaagggcagaccactttgc

SEQ ID NO: 56468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccactttgcaggataaacac

SEQ ID NO: 56469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgcaggataaacactagtga

SEQ ID NO: 56470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaggataaacactagtgac

SEQ ID NO: 56471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcttccacaccttctatca

SEQ ID NO: 56472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctatcatggaaatgatgct

SEQ ID NO: 56473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcatggaaatgatgctta

SEQ ID NO: 56474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaatgatgcttagagataac

SEQ ID NO: 56475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatgcttagagataaccgg

SEQ ID NO: 56476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgcttagagataaccgga

SEQ ID NO: 56477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accggaaggaaatcaaatcc

SEQ ID NO: 56478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccggaaggaaatcaaatccc

SEQ ID NO: 56479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cggaaggaaatcaaatccca

SEQ ID NO: 56480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgctgctttctttgcttct

SEQ ID NO: 56481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgcttctgagatttgtcc

SEQ ID NO: 56482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcttctgagatttgtcct

SEQ ID NO: 56483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcttctgagatttgtcctg

SEQ ID NO: 56484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagatttgtcctggggctt

SEQ ID NO: 56485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accttacattcttgacttgt

SEQ ID NO: 56486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgtaagatgtgctattg

SEQ ID NO: 56487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgtaagatgtgctattga

SEQ ID NO: 56488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaagatgtgctattgaagg

SEQ ID NO: 56489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagatgtgctattgaagga

SEQ ID NO: 56490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctattgaaggaaggaaactt

SEQ ID NO: 56491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaggaaacttcagtgact

SEQ ID NO: 56492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgactgagactgtgcaatg

SEQ ID NO: 56493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgactgagactgtgcaatga

SEQ ID NO: 56494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgtgcaatgaaggtgaac

SEQ ID NO: 56495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctcacttgtgataattct

SEQ ID NO: 56496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattctcagtgccatatcc

SEQ ID NO: 56497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcgccttctcttccctgat

SEQ ID NO: 56498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccttctcttccctgattgg

SEQ ID NO: 56499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctcttccctgattggtgg

SEQ ID NO: 56500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccctgattggtggtagata

SEQ ID NO: 56501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccctgattggtggtagatat

SEQ ID NO: 56502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgattggtggtagatatagg

SEQ ID NO: 56503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggtggtagatataggaag

SEQ ID NO: 56504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtggtagatataggaagaa

SEQ ID NO: 56505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagaagagttcaactgcaa

SEQ ID NO: 56506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaagagttcaactgcaat

SEQ ID NO: 56507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcaactgcaataggaataa

SEQ ID NO: 56508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaataatggtcttttttat

SEQ ID NO: 56509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtcttttttattagatgc

SEQ ID NO: 56510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttttaaaattttatttt

SEQ ID NO: 56511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttaaaattttattttta

SEQ ID NO: 56512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttatttttagagcaattt

SEQ ID NO: 56513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatttttagagcaatttt

SEQ ID NO: 56514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttagagcaattttaggttca

SEQ ID NO: 56515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaggttcacagcaaaactg

SEQ ID NO: 56516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggttcacagcaaaactga

SEQ ID NO: 56517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggttcacagcaaaactgaa

SEQ ID NO: 56518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcacagcaaaactgaagg

SEQ ID NO: 56519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcacagcaaaactgaaggg

SEQ ID NO: 56520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcacagcaaaactgaaggga

SEQ ID NO: 56521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaaaactgaagggagggta

SEQ ID NO: 56522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaactgaagggagggtaca

SEQ ID NO: 56523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cataaccgctactcccacac

SEQ ID NO: 56524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccgctactcccacacaagaa

SEQ ID NO: 56525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccattatcaacattccccac

SEQ ID NO: 56526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaattaatgaacttacttt

SEQ ID NO: 56527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaattaatgaacttactttg

SEQ ID NO: 56528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaggtttcattatctccc

SEQ ID NO: 56529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaggtttcattatctccca

SEQ ID NO: 56530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcattatctcccaaggtctg

SEQ ID NO: 56531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaggtctgtagttcacatt

SEQ ID NO: 56532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggtctgtagttcacattt

SEQ ID NO: 56533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggtctgtagttcacattta

SEQ ID NO: 56534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtagttcacatttagggt

SEQ ID NO: 56535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacatttagggttagctca

SEQ ID NO: 56536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatggtgttgtccattcta

SEQ ID NO: 56537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catggtgttgtccattctat

SEQ ID NO: 56538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atggtgttgtccattctatg

SEQ ID NO: 56539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttgtccattctatggggt

SEQ ID NO: 56540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgtccattctatggggtt

SEQ ID NO: 56541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgacatgtatccaccatta

SEQ ID NO: 56542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccaccattacagtatctta

SEQ ID NO: 56543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caccattacagtatcttaca

SEQ ID NO: 56544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtatcttacagagtaattt

SEQ ID NO: 56545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatctcccatttcaacccc

SEQ ID NO: 56546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcccatttcaacccctggc

SEQ ID NO: 56547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatcattttactgtcttta

SEQ ID NO: 56548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttatagttttgccttctc

SEQ ID NO: 56549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatagttttgccttctcc

SEQ ID NO: 56550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccttctccaggatatccta

SEQ ID NO: 56551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcctatagttgcaataata

SEQ ID NO: 56552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttgcaataatacagaata

SEQ ID NO: 56553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatacagaatatagcccttt

SEQ ID NO: 56554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcagattgactcctttcact

SEQ ID NO: 56555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcacttagcaatatgcttt

SEQ ID NO: 56556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcttttagttttcctcca

SEQ ID NO: 56557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttcctccatggcttttca

SEQ ID NO: 56558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catggcttttcatagcttga

SEQ ID NO: 56559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgatagctcatttcttta

SEQ ID NO: 56560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaataatattccattgac

SEQ ID NO: 56561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataatattccattgactgg

SEQ ID NO: 56562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccattgactggtggtacca

SEQ ID NO: 56563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttattcattcacctactg

SEQ ID NO: 56564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttattcattcacctactga

SEQ ID NO: 56565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggacatcttgtttgcttcc

SEQ ID NO: 56566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgtttgcttccaagttt

SEQ ID NO: 56567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttttagcaattatgcgta

SEQ ID NO: 56568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctctataaacatctttgtg

SEQ ID NO: 56569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctataaacatctttgtga

SEQ ID NO: 56570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttgtgaaggttactgtg

SEQ ID NO: 56571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactgtgtggacatgttttc

SEQ ID NO: 56572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggacatgttttcaagtcctt

SEQ ID NO: 56573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacatgttttcaagtccttt

SEQ ID NO: 56574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtcctttgggtgaacatc

SEQ ID NO: 56575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcctttgggtgaacatca

SEQ ID NO: 56576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctttgggtgaacatcaag

SEQ ID NO: 56577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatcaaggagcacaattgc

SEQ ID NO: 56578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcacaattgctggatcata

SEQ ID NO: 56579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caattgctggatcatatggt

SEQ ID NO: 56580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgctggatcatatggtga

SEQ ID NO: 56581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatatggtgagagtatgtt

SEQ ID NO: 56582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagagtatgtttagttttta

SEQ ID NO: 56583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactgctacactgtcctca

SEQ ID NO: 56584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgctacactgtcctcaaag

SEQ ID NO: 56585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacactgtcctcaaagtggc

SEQ ID NO: 56586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactgtcctcaaagtggctg

SEQ ID NO: 56587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagcattttgcattcccac

SEQ ID NO: 56588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattcccaccagcaatacat

SEQ ID NO: 56589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcccaccagcaatacatga

SEQ ID NO: 56590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcctgttgcctcacatcct

SEQ ID NO: 56591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttgcctcacatccttggc

SEQ ID NO: 56592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggccagaacttgatatcat

SEQ ID NO: 56593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttgatatcatcagtgttc

SEQ ID NO: 56594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcatcagtgttctggattt

SEQ ID NO: 56595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggttattccaatacatatg

SEQ ID NO: 56596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttattccaatacatatgtgg

SEQ ID NO: 56597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcccattgttgataccat

SEQ ID NO: 56598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcccctgtgatatatgatg

SEQ ID NO: 56599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcaatatgtgcatcttctt

SEQ ID NO: 56600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcatcttctttggtctgtt

SEQ ID NO: 56601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcatcttctttggtctgtta

SEQ ID NO: 56602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttggtctgttaaggtata

SEQ ID NO: 56603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatggcccatttttttcat

SEQ ID NO: 56604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatggcccatttttttcatt

SEQ ID NO: 56605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatttcttttcttgttgtt

SEQ ID NO: 56606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttcttgttgttgagtttt

SEQ ID NO: 56607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagctttatttgtatattt

SEQ ID NO: 56608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttgtatattttggttaa

SEQ ID NO: 56609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttggttaacagtcatttgt

SEQ ID NO: 56610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcaaatatttatctaacac

SEQ ID NO: 56611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggcttgttgtccgtttttg

SEQ ID NO: 56612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcttgttgtccgtttttgca

SEQ ID NO: 56613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttgtccgtttttgcagag

SEQ ID NO: 56614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtccgtttttgcagagcag

SEQ ID NO: 56615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaagtttttaattttaatg

SEQ ID NO: 56616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattttaatgcagttcacct

SEQ ID NO: 56617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttagcaattatgtctctta

SEQ ID NO: 56618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgcctttgctgttatatc

SEQ ID NO: 56619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctagaataacacatatgt

SEQ ID NO: 56620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatatgttagatacattct

SEQ ID NO: 56621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatgttagatacattctta

SEQ ID NO: 56622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttagatacattcttagag

SEQ ID NO: 56623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catattatatattccacttt

SEQ ID NO: 56624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactttaagcatccattaac

SEQ ID NO: 56625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttactattctcaatatatc

SEQ ID NO: 56626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttactattctcaatatatct

SEQ ID NO: 56627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatatatctaggttcttgt

SEQ ID NO: 56628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatatctaggttcttgtta

SEQ ID NO: 56629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatcttcaaacataaaatcc

SEQ ID NO: 56630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccaaaaataaaatcctct

SEQ ID NO: 56631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatcctcttggtctgact

SEQ ID NO: 56632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatcctcttggtctgactg

SEQ ID NO: 56633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcctcttggtctgactga

SEQ ID NO: 56634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgactgagggatcccttg

SEQ ID NO: 56635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgactgagggatcccttgc

SEQ ID NO: 56636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccttgcaggattttccctgt

SEQ ID NO: 56637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggattttccctgtgagctca

SEQ ID NO: 56638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gattttccctgtgagctcat

SEQ ID NO: 56639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccctgtgagctcataggca

SEQ ID NO: 56640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagctcataggcaaagcat

SEQ ID NO: 56641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagctcataggcaaagcatt

SEQ ID NO: 56642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcttttatgtgccattcc

SEQ ID NO: 56643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgtgccattcctagtcta

SEQ ID NO: 56644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcctagtctacagaacat

SEQ ID NO: 56645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtgtttttcttgctcttt

SEQ ID NO: 56646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtttttcttgctcttttgg

SEQ ID NO: 56647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgctcttttggcagccc

SEQ ID NO: 56648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagccctagaaattttatct

SEQ ID NO: 56649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attttatcttggtttaaacc

SEQ ID NO: 56650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttggtttaaacccagaaa

SEQ ID NO: 56651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttattaaatactacactgca

SEQ ID NO: 56652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atactacactgcacagcctt

SEQ ID NO: 56653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actacactgcacagccttga

SEQ ID NO: 56654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcattaaacactaaatga

SEQ ID NO: 56655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaacactaaatgacagcgt

SEQ ID NO: 56656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaatgacagcgtcagatg

SEQ ID NO: 56657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagcgtcagatgtagacat

SEQ ID NO: 56658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcgtcagatgtagacataag

SEQ ID NO: 56659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagatgtagacataagtaga

SEQ ID NO: 56660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatggtacgtttaaaattta

SEQ ID NO: 56661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggtacgtttaaaatttaa

SEQ ID NO: 56662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggtacgtttaaaatttaaa

SEQ ID NO: 56663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacgtttaaaatttaaaggg

SEQ ID NO: 56664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acgtttaaaatttaaagggt

SEQ ID NO: 56665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaagggtaggcttgaatt

SEQ ID NO: 56666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaagggtaggcttgaatta

SEQ ID NO: 56667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagggtaggcttgaattaa

SEQ ID NO: 56668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggcttgaattaagggaac

SEQ ID NO: 56669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaattaagggaaccagaca

SEQ ID NO: 56670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaccagacaaagcctgtc

SEQ ID NO: 56671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagcctgtctggttgaaa

SEQ ID NO: 56672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaaagccaataaccaat

SEQ ID NO: 56673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaactgaccttccgtaact

SEQ ID NO: 56674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgaccttccgtaacttaga

SEQ ID NO: 56675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaacttagatagaaaaatg

SEQ ID NO: 56676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagaaaaatgtggaaatgtt

SEQ ID NO: 56677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtggaaatgttgagtca

SEQ ID NO: 56678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taacatcatacaatccatac

SEQ ID NO: 56679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatacaatccataccagaa

SEQ ID NO: 56680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catacaatccataccagaat

SEQ ID NO: 56681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccataccagaataggaat

SEQ ID NO: 56682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataagaattttatttccct

SEQ ID NO: 56683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaattttatttcccttagt

SEQ ID NO: 56684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcccttagtgagaaataaa

SEQ ID NO: 56685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactgcaattttcaaaactg

SEQ ID NO: 56686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaattttcaaaactgtag

SEQ ID NO: 56687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcaaaactgtagaagtttc

SEQ ID NO: 56688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaactgtagaagtttctgg

SEQ ID NO: 56689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttctggaagaacaaaaaa

SEQ ID NO: 56690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctggaagaacaaaaaataga

SEQ ID NO: 56691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaatagacagtaatatt

SEQ ID NO: 56692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaatagacagtaatatta

SEQ ID NO: 56693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaattaatacaatactga

SEQ ID NO: 56694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaattaatacaatactgaaa

SEQ ID NO: 56695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtttttctctaattaaa

SEQ ID NO: 56696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtttttctctaattaaat

SEQ ID NO: 56697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctctaattaaataggat

SEQ ID NO: 56698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacttttaccttctaatat

SEQ ID NO: 56699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
accttctaatattggctgca

SEQ ID NO: 56700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctgcacggcaatattaca

SEQ ID NO: 56701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacggcaatattacaaagt

SEQ ID NO: 56702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caattattctgttgtgaaaa

SEQ ID NO: 56703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattctgttgtgaaaatag

SEQ ID NO: 56704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgtgaaaatagaagaata

SEQ ID NO: 56705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatagaagaataaagttac

SEQ ID NO: 56706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacaagttttgtgtataca

SEQ ID NO: 56707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtgtatacatagctaaa

SEQ ID NO: 56708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtatacatagctaaaaag

SEQ ID NO: 56709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtatacatagctaaaaagt

SEQ ID NO: 56710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agctaaaaagtaggattcaa

SEQ ID NO: 56711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaagtaggattcaaaag

SEQ ID NO: 56712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacttcaaattataactaaa

SEQ ID NO: 56713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattataactaaaaagaaa

SEQ ID NO: 56714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaatagaatatacaatg

SEQ ID NO: 56715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatatacaatgaagattat

SEQ ID NO: 56716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaatgaagattatcagaca

SEQ ID NO: 56717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagattatcagacatagat

SEQ ID NO: 56718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agattatcagacatagattg

SEQ ID NO: 56719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagacatagattggagtgat

SEQ ID NO: 56720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catagattggagtgatgaga

SEQ ID NO: 56721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atagattggagtgatgagat

SEQ ID NO: 56722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgcttaatgaaacaactg

SEQ ID NO: 56723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatgaaacaactgaagaa

SEQ ID NO: 56724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgaaacaactgaagaaaa

SEQ ID NO: 56725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaaacaactgaagaaaag

SEQ ID NO: 56726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaggtttcctaaatgtat

SEQ ID NO: 56727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctaaatgtattggcatct

SEQ ID NO: 56728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgctcgtctaatttgacg

SEQ ID NO: 56729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcgtctaatttgacgtggtc

SEQ ID NO: 56730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgacgtggtctggatttttt

SEQ ID NO: 56731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggtctggatttttttggc

SEQ ID NO: 56732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggccagaaaactgatgtg

SEQ ID NO: 56733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaatgttttgtcttgcatg

SEQ ID NO: 56734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttttgtcttgcatgtag

SEQ ID NO: 56735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgcatgtagtagatgct

SEQ ID NO: 56736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatgtagtagatgcttagt

SEQ ID NO: 56737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattgattacttattcctg

SEQ ID NO: 56738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattcctgaagaattttccc

SEQ ID NO: 56739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaattttccccagtgtca

SEQ ID NO: 56740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagtgtcatagtccactga

SEQ ID NO: 56741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagtgtcatagtccactgat

SEQ ID NO: 56742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggtcccttaccctaacaa

SEQ ID NO: 56743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgctgataatgtgctttctg

SEQ ID NO: 56744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgataatgtgctttctgtg

SEQ ID NO: 56745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgttatcgacattcccttg

SEQ ID NO: 56746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcgacattcccttgtag

SEQ ID NO: 56747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccttgtagaagtcttccat

SEQ ID NO: 56748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtagaagtcttccattagat

SEQ ID NO: 56749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaagtcttccattagata

SEQ ID NO: 56750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaagtcttccattagataa

SEQ ID NO: 56751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaagtcttccattagataag

SEQ ID NO: 56752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggacaaaatatatgaaacac

SEQ ID NO: 56753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatatgaaacactagtttt

SEQ ID NO: 56754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacactagttttcagtcat

SEQ ID NO: 56755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacactagttttcagtcatt

SEQ ID NO: 56756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattgggcaacattatctat

SEQ ID NO: 56757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggcaacattatctataaga

SEQ ID NO: 56758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctataagacagtgatccc

SEQ ID NO: 56759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctataagacagtgatcccta

SEQ ID NO: 56760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagacagtgatccctagag

SEQ ID NO: 56761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacagtgatccctagagaa

SEQ ID NO: 56762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtgatccctagagaagaga

SEQ ID NO: 56763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccctagagaagagaaaga

SEQ ID NO: 56764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctagagaagagaaagaaagt

SEQ ID NO: 56765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagagaagagaaagaaagtg

SEQ ID NO: 56766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtctctgcatactacaca

SEQ ID NO: 56767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacacaaagtttctaaacca

SEQ ID NO: 56768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagtttctaaaccacagct

SEQ ID NO: 56769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtttctaaaccacagctc

SEQ ID NO: 56770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctaaaccacagctcagg

SEQ ID NO: 56771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaccacagctcaggaaga

SEQ ID NO: 56772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaggaagatggaaacatg

SEQ ID NO: 56773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggaagatggaaacatgaa

SEQ ID NO: 56774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatggaaacatgaagagc

SEQ ID NO: 56775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatgaagagccagaaaat

SEQ ID NO: 56776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgaagagccagaaaataa

SEQ ID NO: 56777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccagaaaataagagtttga

SEQ ID NO: 56778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccagaaaataagagtttgat

SEQ ID NO: 56779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaataagagtttgataggct

SEQ ID NO: 56780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataagagtttgataggctg

SEQ ID NO: 56781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataagagtttgataggctga

SEQ ID NO: 56782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagagtttgataggctgagg

SEQ ID NO: 56783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttgataggctgagggagc

SEQ ID NO: 56784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagctagaatttgtttatt

SEQ ID NO: 56785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagctagaatttgtttattt

SEQ ID NO: 56786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagaatttgtttatttggga

SEQ ID NO: 56787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaatttgtttatttgggac

SEQ ID NO: 56788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttgggacaggacacct

SEQ ID NO: 56789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggacaggacacctaagac

SEQ ID NO: 56790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggacaggacacctaagaca

SEQ ID NO: 56791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggacaggacacctaagacaa

SEQ ID NO: 56792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaggacacctaagacaagg

SEQ ID NO: 56793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctaagacaagggagctgaa

SEQ ID NO: 56794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagacaagggagctgaaca

SEQ ID NO: 56795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacaagggagctgaacaga

SEQ ID NO: 56796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagctgaacagagagtatac

SEQ ID NO: 56797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctgaacagagagtatacca

SEQ ID NO: 56798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagagtataccagagatctg

SEQ ID NO: 56799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtataccagagatctgtaga

SEQ ID NO: 56800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataccagagatctgtagaaa

SEQ ID NO: 56801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatctgtagaaagagacctc

SEQ ID NO: 56802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacctcaagtttttgcttga

SEQ ID NO: 56803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgaaaacaaaaataccct

SEQ ID NO: 56804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacaaaaataccctaagc

SEQ ID NO: 56805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacaaaaataccctaagcca

SEQ ID NO: 56806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaataccctaagccagaga

SEQ ID NO: 56807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaagccagagaaagaacta

SEQ ID NO: 56808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcatgcattgcctaacaa

SEQ ID NO: 56809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatgcattgcctaacaatg

SEQ ID NO: 56810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacaatggagatatgtacc

SEQ ID NO: 56811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaccgagaaatgtgtcac

SEQ ID NO: 56812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaccgagaaatgtgtcact

SEQ ID NO: 56813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actaggcaattttaacatca

SEQ ID NO: 56814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggcaattttaacatcata

SEQ ID NO: 56815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattttaacatcatagaga

SEQ ID NO: 56816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacagtacttacacaaacc

SEQ ID NO: 56817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtacttacacaaacctaga

SEQ ID NO: 56818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacacaaacctagatggta

SEQ ID NO: 56819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtatagtctactacatact

SEQ ID NO: 56820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tactacatacttagtcttta

SEQ ID NO: 56821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catacttagtctttatggta

SEQ ID NO: 56822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggtatagcctattgcttc

SEQ ID NO: 56823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtatagcctattgcttct

SEQ ID NO: 56824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtacaacatgttactgtact

SEQ ID NO: 56825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtactgagacaattgtaaca

SEQ ID NO: 56826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgagacaattgtaacacag

SEQ ID NO: 56827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtctaatcatacctaaaca

SEQ ID NO: 56828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcatacctaaacatagaa

SEQ ID NO: 56829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctaaacatagaaaagtta

SEQ ID NO: 56830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaagttacagtaaaaata

SEQ ID NO: 56831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatacagtattataatctg

SEQ ID NO: 56832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatacagtattataatctgt

SEQ ID NO: 56833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggaccaccatcatatatg

SEQ ID NO: 56834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcagtctgtccttgactg

SEQ ID NO: 56835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccttgactgaagtgttatc

SEQ ID NO: 56836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgacatgactgtaatctt

SEQ ID NO: 56837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacatgactgtaatcttaag

SEQ ID NO: 56838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgactgtaatcttaagtag

SEQ ID NO: 56839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgactgtaatcttaagtagc

SEQ ID NO: 56840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtagcaggttaaaaattct

SEQ ID NO: 56841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaattcttggacctcaca

SEQ ID NO: 56842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaattcttggacctcacac

SEQ ID NO: 56843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaattcttggacctcacaca

SEQ ID NO: 56844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttggacctcacacaggga

SEQ ID NO: 56845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtaatattttatcctccc

SEQ ID NO: 56846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattttatcctccccagtca

SEQ ID NO: 56847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctccccagtcaaagtgaa

SEQ ID NO: 56848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgaaaagacctcaaaaca

SEQ ID NO: 56849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgaaaagacctcaaaacac

SEQ ID NO: 56850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaagacctcaaaacacag

SEQ ID NO: 56851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctcaaaacacaggagatat

SEQ ID NO: 56852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcaaaacacaggagatatt

SEQ ID NO: 56853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacacaggagatattggg

SEQ ID NO: 56854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatattgggtagactctg

SEQ ID NO: 56855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattgggtagactctgcag

SEQ ID NO: 56856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattgggtagactctgcaga

SEQ ID NO: 56857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgggtagactctgcagaa

SEQ ID NO: 56858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgcagaagggtcttatct

SEQ ID NO: 56859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagaagggtcttatcttag

SEQ ID NO: 56860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagggtcttatcttagcag

SEQ ID NO: 56861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagggtcttatcttagcagt

SEQ ID NO: 56862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggtcttatcttagcagtg

SEQ ID NO: 56863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactttaactaacgttgctc

SEQ ID NO: 56864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaagtatgaatcatggat

SEQ ID NO: 56865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaatgtctataaaagtatg

SEQ ID NO: 56866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacaatgtctataaaagta

SEQ ID NO: 56867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctctgacaatgtctataa

SEQ ID NO: 56868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaacgactgatctctgaca

SEQ ID NO: 56869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccagttgacaacgactgat

SEQ ID NO: 56870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccccagttgacaacgactga

SEQ ID NO: 56871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggggacaaaatcttcccc

SEQ ID NO: 56872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagggggacaaaatcttcc

SEQ ID NO: 56873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgttctcagggggacaaa

SEQ ID NO: 56874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaatgttctcagggggac

SEQ ID NO: 56875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaaatgttctcaggggga

SEQ ID NO: 56876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctaaatgttctcaggggg

SEQ ID NO: 56877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacaaataaaaatgtcccc

SEQ ID NO: 56878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacagttatgacaaataaaa

SEQ ID NO: 56879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attccacagttatgacaaat

SEQ ID NO: 56880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaattccacagttatgaca

SEQ ID NO: 56881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatatcaataaacattccta

SEQ ID NO: 56882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagatatcaataaacattcc

SEQ ID NO: 56883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acctctagatatcaataaac

SEQ ID NO: 56884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taacctctagatatcaataa

SEQ ID NO: 56885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctctaacctctagatatc

SEQ ID NO: 56886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacgatcactggtctctaa

SEQ ID NO: 56887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcacgatcactggtctcta

SEQ ID NO: 56888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcatggtgggatgtttagc

SEQ ID NO: 56889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctgtgcatggtgggatgt

SEQ ID NO: 56890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagtggctgtcctgtgcat

SEQ ID NO: 56891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtgagtggctgtcctgtg

SEQ ID NO: 56892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtgagtggctgtcctgt

SEQ ID NO: 56893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttgtgagtggctgtcctg

SEQ ID NO: 56894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgttgtgagtggctgtcc

SEQ ID NO: 56895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataattctttgttgtgagt

SEQ ID NO: 56896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctggataattctttgttg

SEQ ID NO: 56897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagctggataattctttgtt

SEQ ID NO: 56898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatttgagctggataattc

SEQ ID NO: 56899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatatttgagctggataatt

SEQ ID NO: 56900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatcttgatatttgagct

SEQ ID NO: 56901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatattggcaatcttgatat

SEQ ID NO: 56902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaatattggcaatcttgat

SEQ ID NO: 56903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaatattggcaatcttga

SEQ ID NO: 56904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtttctcaatattggcaat

SEQ ID NO: 56905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggcctgagtttctcaatat

SEQ ID NO: 56906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaggcctgagtttctcaat

SEQ ID NO: 56907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaaggcctgagtttctca

SEQ ID NO: 56908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaaggcctgagtttctc

SEQ ID NO: 56909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctctaaggcctgagttt

SEQ ID NO: 56910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctctaaggcctgagtt

SEQ ID NO: 56911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatcagacatttatttctc

SEQ ID NO: 56912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattaaaatcagacatttat

SEQ ID NO: 56913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacattaaaatcagacattt

SEQ ID NO: 56914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatacattctacattaaaa

SEQ ID NO: 56915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatacattctacattaaa

SEQ ID NO: 56916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatatacattctacattaa

SEQ ID NO: 56917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaatgaaaactttcatat

SEQ ID NO: 56918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaagtagaaaaaaaacag

SEQ ID NO: 56919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaaagtagaaaaaaaaca

SEQ ID NO: 56920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacaaagtagaaaaaaaac

SEQ ID NO: 56921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagctttaacaaagtagaaa

SEQ ID NO: 56922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatagctttaacaaagtaga

SEQ ID NO: 56923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctatagctttaacaaagt

SEQ ID NO: 56924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctatagctttaacaaag

SEQ ID NO: 56925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctctatagctttaacaaa

SEQ ID NO: 56926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctctatagctttaacaa

SEQ ID NO: 56927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtgtttttcctctatag

SEQ ID NO: 56928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttaaaagtgtttttcctc

SEQ ID NO: 56929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggactaagttaaaagtgt

SEQ ID NO: 56930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggactaagttaaaagtg

SEQ ID NO: 56931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaggactaagttaaaagt

SEQ ID NO: 56932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaggactaagttaaaag

SEQ ID NO: 56933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatttttgaaggactaagt

SEQ ID NO: 56934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatagaaaactggcatttt

SEQ ID NO: 56935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaaataaaattagtatag

SEQ ID NO: 56936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcacaaaataaaattagta

SEQ ID NO: 56937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccactgctcacaaaataa

SEQ ID NO: 56938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaactgtcccactgctcaca

SEQ ID NO: 56939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaactgtcccactgctcac

SEQ ID NO: 56940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtggatgtttgaaactgtc

SEQ ID NO: 56941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatggtaagttgagtggat

SEQ ID NO: 56942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacatggtaagttgagtgga

SEQ ID NO: 56943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacatggtaagttgagtgg

SEQ ID NO: 56944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacatgtctttcacatggta

SEQ ID NO: 56945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagagactatacatgtctt

SEQ ID NO: 56946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctgagagagactatacat

SEQ ID NO: 56947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggcctgagagagactatac

SEQ ID NO: 56948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggcctgagagagactata

SEQ ID NO: 56949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctggcctgagagagactat

SEQ ID NO: 56950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacagtgccagtgctttctg

SEQ ID NO: 56951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacagtgccagtgctttct

SEQ ID NO: 56952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatacagtgccagtgcttt

SEQ ID NO: 56953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattcttatacagtgccagt

SEQ ID NO: 56954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattcttatacagtgccag

SEQ ID NO: 56955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacattcttatacagtgcc

SEQ ID NO: 56956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacaaaagtatagtgtattc

SEQ ID NO: 56957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacaaaagtatagtgtat

SEQ ID NO: 56958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcaacaaaagtatagtgta

SEQ ID NO: 56959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caggatcttctcaacaaaag

SEQ ID NO: 56960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaggatcttctcaacaaaa

SEQ ID NO: 56961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgcaggatcttctcaaca

SEQ ID NO: 56962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttgcaggatcttctcaa

SEQ ID NO: 56963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttgcaggatcttctca

SEQ ID NO: 56964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgtttgcaggatcttctc

SEQ ID NO: 56965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctgtttgcaggatcttc

SEQ ID NO: 56966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttctgtttgcaggatctt

SEQ ID NO: 56967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttctgtttgcaggatct

SEQ ID NO: 56968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatagttttctttctgtttg

SEQ ID NO: 56969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcctcaatagttttctttc

SEQ ID NO: 56970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagcctcaatagttttcttt

SEQ ID NO: 56971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgcttcagcctcaatagt

SEQ ID NO: 56972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgtgtgcttcagcctca

SEQ ID NO: 56973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatctgtgtgcttcagcctc

SEQ ID NO: 56974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttaatctgtgtgcttcag

SEQ ID NO: 56975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctatcttaatctgtgtgct

SEQ ID NO: 56976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctatcttaatctgtgtgc

SEQ ID NO: 56977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctatcttaatctgtgtg

SEQ ID NO: 56978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttccctatcttaatctgtg

SEQ ID NO: 56979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctctttccctatcttaatc

SEQ ID NO: 56980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctctttccctatcttaat

SEQ ID NO: 56981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttccctctttccctatct

SEQ ID NO: 56982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcttccctctttccctatc

SEQ ID NO: 56983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatcttccctctttcccta

SEQ ID NO: 56984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcttatcttccctctttcc

SEQ ID NO: 56985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgctcttatcttccctct

SEQ ID NO: 56986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caccatgtcagcctcactgc

SEQ ID NO: 56987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagccctacaccatgtcagc

SEQ ID NO: 56988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagccctacaccatgtcag

SEQ ID NO: 56989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccagccctacaccatgtca

SEQ ID NO: 56990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagctttccagccctacac

SEQ ID NO: 56991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaagctttccagccctac

SEQ ID NO: 56992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagttctacaagctttcca

SEQ ID NO: 56993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctacaagttctacaagctt

SEQ ID NO: 56994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtctacaagttctacaag

SEQ ID NO: 56995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactgtctacaagttctac

SEQ ID NO: 56996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactattactgtctacaagt

SEQ ID NO: 56997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactattactgtctacaa

SEQ ID NO: 56998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaactctatactattactg

SEQ ID NO: 56999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaactctatactattact

SEQ ID NO: 57000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaactctatactattac

SEQ ID NO: 57001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaaagattttacaaactc

SEQ ID NO: 57002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatcctcagcaaagatttt

SEQ ID NO: 57003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaatcctcagcaaagatt

SEQ ID NO: 57004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatgataaattctaaaatc

SEQ ID NO: 57005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgatgataaattctaaa

SEQ ID NO: 57006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattattatgatgataaatt

SEQ ID NO: 57007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccattattatgatgataaa

SEQ ID NO: 57008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccattattatgatgataa

SEQ ID NO: 57009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatatttctccattattat

SEQ ID NO: 57010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaatatttctccattatt

SEQ ID NO: 57011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cggcataaaattctgtaata

SEQ ID NO: 57012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccggcataaaattctgtaat

SEQ ID NO: 57013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccggcataaaattctgtaa

SEQ ID NO: 57014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcattttccggcataaaa

SEQ ID NO: 57015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtcattttccggcataaa

SEQ ID NO: 57016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggtcattttccggcataa

SEQ ID NO: 57017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattttgggtcattttccg

SEQ ID NO: 57018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaattttgggtcattttcc

SEQ ID NO: 57019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttaaaattttgggtcattt

SEQ ID NO: 57020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgcttaaaattttgggtc

SEQ ID NO: 57021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgcttaaaattttgggt

SEQ ID NO: 57022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacatttccctgcttaaaa

SEQ ID NO: 57023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaggttgtgacatttccct

SEQ ID NO: 57024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaggttgtgacatttccc

SEQ ID NO: 57025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaggttgtgacatttcc

SEQ ID NO: 57026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtacagtagccagagtgga

SEQ ID NO: 57027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagtacagtagccagagtg

SEQ ID NO: 57028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctcagtacagtagccaga

SEQ ID NO: 57029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaatctattctcagtacag

SEQ ID NO: 57030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaatctattctcagtaca

SEQ ID NO: 57031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttccaaatctattctcag

SEQ ID NO: 57032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcacttccaaatctattc

SEQ ID NO: 57033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctcacttccaaatctatt

SEQ ID NO: 57034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgcctcacttccaaatcta

SEQ ID NO: 57035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatccattcttgcctcactt

SEQ ID NO: 57036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaatccattcttgcctca

SEQ ID NO: 57037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actaaatccattcttgcctc

SEQ ID NO: 57038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttactaaatccattcttg

SEQ ID NO: 57039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttactaaatccattctt

SEQ ID NO: 57040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcttactaaatccattct

SEQ ID NO: 57041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttatcttactaaatccat

SEQ ID NO: 57042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttatcttactaaatcca

SEQ ID NO: 57043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgttttatcttactaaat

SEQ ID NO: 57044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagacaatgtaataaccta

SEQ ID NO: 57045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagacaatgtaataacct

SEQ ID NO: 57046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataagacaatgtaataacc

SEQ ID NO: 57047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttataagacaatgtaataa

SEQ ID NO: 57048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctctttataagacaatgt

SEQ ID NO: 57049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctctttataagacaatg

SEQ ID NO: 57050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacctctttataagacaat

SEQ ID NO: 57051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacctttaacctctttata

SEQ ID NO: 57052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccaatccattaccacctt

SEQ ID NO: 57053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaacacctaatccaatcca

SEQ ID NO: 57054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactgtcaacacctaatcca

SEQ ID NO: 57055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactgtcaacacctaatcc

SEQ ID NO: 57056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttccactgtcaacaccta

SEQ ID NO: 57057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttccactgtcaacacct

SEQ ID NO: 57058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaatttccactgtcaacac

SEQ ID NO: 57059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttaatttccactgtcaac

SEQ ID NO: 57060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcttaatttccactgtcaa

SEQ ID NO: 57061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtaatgtaaatacatcaa

SEQ ID NO: 57062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccacctaatgtaatgtaaat

SEQ ID NO: 57063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taccacctaatgtaatgtaa

SEQ ID NO: 57064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctaccacctaatgtaat

SEQ ID NO: 57065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaagaccagttcattcta

SEQ ID NO: 57066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaccaagaccagttcatt

SEQ ID NO: 57067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaccaagaccagttcat

SEQ ID NO: 57068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcatttattcaccaagacc

SEQ ID NO: 57069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accctccgcatttattcacc

SEQ ID NO: 57070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaaccctccgcatttatt

SEQ ID NO: 57071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattaaccctccgcatttat

SEQ ID NO: 57072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcattaaccctccgcattt

SEQ ID NO: 57073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctcttcattaaccctcc

SEQ ID NO: 57074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaactaatcctcttcatta

SEQ ID NO: 57075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaactaatcctcttcatt

SEQ ID NO: 57076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaaactaatcctcttcat

SEQ ID NO: 57077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccagttttccaaactaat

SEQ ID NO: 57078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaccaccattcatccagtt

SEQ ID NO: 57079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attagtaccaccattcatcc

SEQ ID NO: 57080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgattagtaccaccattc

SEQ ID NO: 57081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattgattagtaccaccat

SEQ ID NO: 57082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcattgattagtaccacca

SEQ ID NO: 57083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctcattgattagtacca

SEQ ID NO: 57084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttctcattgattagtacc

SEQ ID NO: 57085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcttccttctcattgatt

SEQ ID NO: 57086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatatcatggtaaataaatt

SEQ ID NO: 57087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agggacaactgtatatcatg

SEQ ID NO: 57088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggagtccagaagccaatc

SEQ ID NO: 57089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagggagtccagaagccaa

SEQ ID NO: 57090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattctcagggagtccaga

SEQ ID NO: 57091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtattctcagggagtccag

SEQ ID NO: 57092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtattctcagggagtcca

SEQ ID NO: 57093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggattttggtattctcagg

SEQ ID NO: 57094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcatctgtggattttggta

SEQ ID NO: 57095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcatctgtggattttggt

SEQ ID NO: 57096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataagagatttgagcatct

SEQ ID NO: 57097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtataagagatttgagcatc

SEQ ID NO: 57098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgccatttgtataagagatt

SEQ ID NO: 57099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagcaaacactatgccatt

SEQ ID NO: 57100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataggaggatgtgtgtagg

SEQ ID NO: 57101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactatataggaggatgtgt

SEQ ID NO: 57102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaactatataggaggatgtg

SEQ ID NO: 57103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaactatataggaggatgt

SEQ ID NO: 57104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatccatacaaatgaagtga

SEQ ID NO: 57105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattgaatccatacaaatga

SEQ ID NO: 57106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtactacattgaatccata

SEQ ID NO: 57107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatgctgagtactacatt

SEQ ID NO: 57108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatatgctgagtactacat

SEQ ID NO: 57109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatatgctgagtactaca

SEQ ID NO: 57110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttccatatgctgagta

SEQ ID NO: 57111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattttccatatgctgagt

SEQ ID NO: 57112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggaaaaaatccacaaagcc

SEQ ID NO: 57113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcagaaatagttggggaa

SEQ ID NO: 57114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatcagaaatagttgggg

SEQ ID NO: 57115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccaattctggatcagaaa

SEQ ID NO: 57116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggattcaaccaattctgga

SEQ ID NO: 57117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctgtggattcaaccaatt

SEQ ID NO: 57118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatctgtggattcaaccaa

SEQ ID NO: 57119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatctgtggattcaacca

SEQ ID NO: 57120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catatccatggtttctgatc

SEQ ID NO: 57121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcctccatatccatggtt

SEQ ID NO: 57122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atggtggaagatatatatat

SEQ ID NO: 57123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctcatggtggaagatata

SEQ ID NO: 57124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggaatactaatctcatgg

SEQ ID NO: 57125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataggaatactaatctcat

SEQ ID NO: 57126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctataggaatactaatctca

SEQ ID NO: 57127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctataggaatactaatctc

SEQ ID NO: 57128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctataggaatactaatct

SEQ ID NO: 57129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctataggaatactaatc

SEQ ID NO: 57130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctataggaatactaat

SEQ ID NO: 57131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttctataggaatacta

SEQ ID NO: 57132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttttctataggaatact

SEQ ID NO: 57133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttttttctataggaata

SEQ ID NO: 57134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttcttttttctataggaa

SEQ ID NO: 57135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctctcttcttttttctat

SEQ ID NO: 57136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtctctcttcttttttct

SEQ ID NO: 57137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatggaggaggcagtgagc

SEQ ID NO: 57138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaatggaggaggcagtgag

SEQ ID NO: 57139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcttcaaatggaggaggc

SEQ ID NO: 57140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgtgtcttcaaatggagg

SEQ ID NO: 57141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactgtgtcttcaaatgga

SEQ ID NO: 57142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagagggcagcattctcac

SEQ ID NO: 57143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctggcagagggcagcattc

SEQ ID NO: 57144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggctggcagagggcagca

SEQ ID NO: 57145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctggctggcagagggcagc

SEQ ID NO: 57146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttcctggctggcagaggg

SEQ ID NO: 57147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccagtgagggctcatttcc

SEQ ID NO: 57148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttccccagtgagggctcat

SEQ ID NO: 57149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgttccccagtgagggctca

SEQ ID NO: 57150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcgccagccaatttcgtt

SEQ ID NO: 57151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggagtccaagattaaggcg

SEQ ID NO: 57152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccgaggctgaggagtccaag

SEQ ID NO: 57153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagttcccgaggctgagga

SEQ ID NO: 57154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacagttcccgaggctgag

SEQ ID NO: 57155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaacagttcccgaggctga

SEQ ID NO: 57156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctaacagttcccgaggc

SEQ ID NO: 57157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctaacagttcccgagg

SEQ ID NO: 57158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaacaacagaaatttatttc

SEQ ID NO: 57159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtggctagaacaacagaaa

SEQ ID NO: 57160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcataataatataccataga

SEQ ID NO: 57161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggctgtcataataatatac

SEQ ID NO: 57162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagctggggctgtcataa

SEQ ID NO: 57163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaagctggggctgtcata

SEQ ID NO: 57164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcttagaaagctggggctg

SEQ ID NO: 57165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttggtcttagaaagctgg

SEQ ID NO: 57166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgttggtcttagaaagctg

SEQ ID NO: 57167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgttggtcttagaaagct

SEQ ID NO: 57168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgttggtcttagaaagc

SEQ ID NO: 57169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttttgtgttggtctta

SEQ ID NO: 57170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcaatagcaggagccaga

SEQ ID NO: 57171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagcaatagcaggagccag

SEQ ID NO: 57172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaaagcaatagcaggagc

SEQ ID NO: 57173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacttaaagcaatagcagg

SEQ ID NO: 57174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggagtcagagataataata

SEQ ID NO: 57175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaagacatgagactcagg

SEQ ID NO: 57176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagaagacatgagactcag

SEQ ID NO: 57177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgcttgcagaagacatga

SEQ ID NO: 57178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatgttacatgcttgcaga

SEQ ID NO: 57179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatgttacatgcttgcag

SEQ ID NO: 57180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcatgttacatgcttgca

SEQ ID NO: 57181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttagcatgttacatgct

SEQ ID NO: 57182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtaacataattcacttta

SEQ ID NO: 57183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agagtaacataattcacttt

SEQ ID NO: 57184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagagtaacataattcact

SEQ ID NO: 57185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcttagagtaacataatt

SEQ ID NO: 57186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactcttagagtaacataat

SEQ ID NO: 57187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatttcactcttagagta

SEQ ID NO: 57188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaagggtgcattatatat

SEQ ID NO: 57189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggaagggtgcattatata

SEQ ID NO: 57190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcaatacatttaaggaag

SEQ ID NO: 57191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtcaatacatttaagga

SEQ ID NO: 57192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgtcaatacatttaagg

SEQ ID NO: 57193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacataaaaagtttctatg

SEQ ID NO: 57194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaacataaaaagtttctat

SEQ ID NO: 57195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttggaacataaaaagttt

SEQ ID NO: 57196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttggaacataaaaagtt

SEQ ID NO: 57197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacgtttcatttggaacat

SEQ ID NO: 57198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaacgtttcatttggaac

SEQ ID NO: 57199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaaacgtttcatttggaa

SEQ ID NO: 57200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagcaaatgtcttctaaaac

SEQ ID NO: 57201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtaggccaagagaatc

SEQ ID NO: 57202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgtaggccaagagaat

SEQ ID NO: 57203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatgtaggccaagagaa

SEQ ID NO: 57204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcctttaaaatgtaggcc

SEQ ID NO: 57205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcccactcatgcctttaaaa

SEQ ID NO: 57206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcccactcatgcctttaaa

SEQ ID NO: 57207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtatacttgtcccactca

SEQ ID NO: 57208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagtcaaagagaatctgaa

SEQ ID NO: 57209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaagtcaaagagaatctg

SEQ ID NO: 57210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaagtcaaagagaatct

SEQ ID NO: 57211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaaagtcaaagagaatc

SEQ ID NO: 57212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaattttctcaaagtcaa

SEQ ID NO: 57213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtaattttctcaaagtca

SEQ ID NO: 57214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccagaagccaaagaaaatg

SEQ ID NO: 57215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccagaagccaaagaaaat

SEQ ID NO: 57216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacccagaagccaaagaaaa

SEQ ID NO: 57217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacccagaagccaaagaaa

SEQ ID NO: 57218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatttttacccagaagcc

SEQ ID NO: 57219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaatttttacccagaagc

SEQ ID NO: 57220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaaagcaccttacaaattt

SEQ ID NO: 57221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcaaagcaccttacaaatt

SEQ ID NO: 57222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcaaagcaccttacaaa

SEQ ID NO: 57223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttggcaaagcaccttac

SEQ ID NO: 57224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcttggcaaagcacctta

SEQ ID NO: 57225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgcaccttattcttggca

SEQ ID NO: 57226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccattcagtgcaccttattc

SEQ ID NO: 57227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accattcagtgcaccttatt

SEQ ID NO: 57228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcgtgtttaccattcagtg

SEQ ID NO: 57229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcctaatcgtgtttaccatt

SEQ ID NO: 57230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actatcctaatcgtgtttac

SEQ ID NO: 57231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgactatcctaatcgtgtt

SEQ ID NO: 57232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgttgactatcctaatcg

SEQ ID NO: 57233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccctgttgactatcctaa

SEQ ID NO: 57234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctccctgttgactatccta

SEQ ID NO: 57235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctccctgttgactatcct

SEQ ID NO: 57236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggaggagattttcctccc

SEQ ID NO: 57237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggaggagattttcctcc

SEQ ID NO: 57238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaaatttaaaggaggag

SEQ ID NO: 57239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcaaaaatttaaaggagga

SEQ ID NO: 57240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttatcaaaaatttaaagg

SEQ ID NO: 57241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatcttatcaaaaatttaa

SEQ ID NO: 57242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgttatcttatcaaaaat

SEQ ID NO: 57243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtagaaagcaaatgttaa

SEQ ID NO: 57244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcccgcaaaagactgatgta

SEQ ID NO: 57245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctcgcccgcaaaagactg

SEQ ID NO: 57246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacactgatctcgcccgca

SEQ ID NO: 57247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcacactgatctcgcccgc

SEQ ID NO: 57248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgagacagtttggcacact

SEQ ID NO: 57249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggaggtaaaaagagaggga

SEQ ID NO: 57250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atacagactgtggaggtaaa

SEQ ID NO: 57251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaccacaatggctcata

SEQ ID NO: 57252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaaaccacaatggctcat

SEQ ID NO: 57253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaaaccacaatggctca

SEQ ID NO: 57254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatcaaaccacaatggc

SEQ ID NO: 57255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaggttattttatcaaac

SEQ ID NO: 57256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctagaaaggttattttatca

SEQ ID NO: 57257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtagaaatacagatgagc

SEQ ID NO: 57258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatgtaccatgttaaggta

SEQ ID NO: 57259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatgtaccatgttaaggt

SEQ ID NO: 57260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaatgtaccatgttaagg

SEQ ID NO: 57261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttccaatgtaccatgtta

SEQ ID NO: 57262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgttttccaatgtaccatg

SEQ ID NO: 57263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaggatcaaacacaaatg

SEQ ID NO: 57264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacaaaggatcaaacacaa

SEQ ID NO: 57265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttacaaaggatcaaacaca

SEQ ID NO: 57266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatcatttgttacaaagga

SEQ ID NO: 57267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatcatttgttacaaagg

SEQ ID NO: 57268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatttgtgatcatttgttac

SEQ ID NO: 57269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaaatttgtgatcatttgt

SEQ ID NO: 57270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctgctaaatttgtgatca

SEQ ID NO: 57271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctgctaaatttgtgatc

SEQ ID NO: 57272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagctgctaaatttgtgat

SEQ ID NO: 57273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaagctgctaaatttgt

SEQ ID NO: 57274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattattttaagctgctaaa

SEQ ID NO: 57275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattattttaagctgctaa

SEQ ID NO: 57276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagataatacatttgtatt

SEQ ID NO: 57277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaaaattgtgagataata

SEQ ID NO: 57278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcacaaaaattgtgagat

SEQ ID NO: 57279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcacaaaaattgtga

SEQ ID NO: 57280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacccaggctcctgcctcac

SEQ ID NO: 57281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaaaacacagataactat

SEQ ID NO: 57282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacaaaacacagataacta

SEQ ID NO: 57283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatacaaaacacagataact

SEQ ID NO: 57284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgtgtctttatacaaaac

SEQ ID NO: 57285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagaacagaaaaaataagt

SEQ ID NO: 57286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacagaacagaaaaaataa

SEQ ID NO: 57287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaacagaacagaaaaaata

SEQ ID NO: 57288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctaacagaacagaaaaa

SEQ ID NO: 57289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attccttctaacagaacaga

SEQ ID NO: 57290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatacactaattccttcta

SEQ ID NO: 57291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atataagaaaaggatataaa

SEQ ID NO: 57292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcatataagaaaaggatat

SEQ ID NO: 57293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctcatataagaaaaggata

SEQ ID NO: 57294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgagaaagaatgatatct

SEQ ID NO: 57295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgagaaagaatgatatc

SEQ ID NO: 57296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgagaaagaatgatat

SEQ ID NO: 57297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatgagaaagaatgata

SEQ ID NO: 57298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttttatatgagaaagaat

SEQ ID NO: 57299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcatttttatatgagaaag

SEQ ID NO: 57300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaactgctcatttttatat

SEQ ID NO: 57301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaactgctcatttttata

SEQ ID NO: 57302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgagaactgctcattttta

SEQ ID NO: 57303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcttgagaactgctcattt

SEQ ID NO: 57304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctactcttgagaactgct

SEQ ID NO: 57305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggctactcttgagaactgc

SEQ ID NO: 57306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaggctactcttgagaact

SEQ ID NO: 57307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttaggctactcttgaga

SEQ ID NO: 57308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgttcttaggctactcttg

SEQ ID NO: 57309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgttcttaggctactct

SEQ ID NO: 57310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctgttcttaggctactc

SEQ ID NO: 57311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcctgttcttaggctact

SEQ ID NO: 57312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtgctttctcctgttc

SEQ ID NO: 57313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaatatgttaaaatgtgct

SEQ ID NO: 57314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacattgacaatatgttaaa

SEQ ID NO: 57315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtacattgacaatatgtta

SEQ ID NO: 57316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctgtacattgacaatatg

SEQ ID NO: 57317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactctgtacattgacaata

SEQ ID NO: 57318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctactctgtacattgacaat

SEQ ID NO: 57319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcttctactctgtacatt

SEQ ID NO: 57320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtcttctactctgtacat

SEQ ID NO: 57321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatcttgtgtcttctact

SEQ ID NO: 57322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatcttgtgtcttctac

SEQ ID NO: 57323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatatcttgtgtcttcta

SEQ ID NO: 57324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaatatcttgtgtcttc

SEQ ID NO: 57325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttaaatatcttgtgtct

SEQ ID NO: 57326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctctttaaatatcttgtg

SEQ ID NO: 57327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctctttaaatatcttgt

SEQ ID NO: 57328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagatttactctctttaaat

SEQ ID NO: 57329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggagcctccagatttactc

SEQ ID NO: 57330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctgaggagcctccagatt

SEQ ID NO: 57331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctgaggagcctccagat

SEQ ID NO: 57332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcccttcatctgaggagcct

SEQ ID NO: 57333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctggcccttcatctgag

SEQ ID NO: 57334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atggctggcccttcatctga

SEQ ID NO: 57335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttatggctggcccttcatc

SEQ ID NO: 57336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttatggctggcccttcat

SEQ ID NO: 57337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttatggctggcccttca

SEQ ID NO: 57338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacttatggctggcccttc

SEQ ID NO: 57339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttacttatggctggccct

SEQ ID NO: 57340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaaatacattcttttact

SEQ ID NO: 57341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacaaatacattcttttac

SEQ ID NO: 57342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaacaaatacattctttta

SEQ ID NO: 57343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttaaacaaatacattctt

SEQ ID NO: 57344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtgctgctttaaacaaa

SEQ ID NO: 57345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgtgctgctttaaacaa

SEQ ID NO: 57346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatttgcatgtgctgcttta

SEQ ID NO: 57347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatgtgagaacataatct

SEQ ID NO: 57348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaatatgtgagaacataat

SEQ ID NO: 57349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaatatgtgagaacataa

SEQ ID NO: 57350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctaaatatgtgagaaca

SEQ ID NO: 57351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatttctaaatatgtgaga

SEQ ID NO: 57352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattactatttctaaatatg

SEQ ID NO: 57353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattaaattactatttcta

SEQ ID NO: 57354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatacactcccattaaat

SEQ ID NO: 57355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatccagtgaatattaagaa

SEQ ID NO: 57356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgggaaaattatatccagtg

SEQ ID NO: 57357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgggaaaattatatccagt

SEQ ID NO: 57358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatttatgggaaaattata

SEQ ID NO: 57359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatttatgggaaaattat

SEQ ID NO: 57360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgatgtgtaaaatttagaa

SEQ ID NO: 57361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgatgtgtaaaatttaga

SEQ ID NO: 57362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgatgtgtaaaatttag

SEQ ID NO: 57363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtgatgtgtaaaattta

SEQ ID NO: 57364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttagtgatgtgtaaaat

SEQ ID NO: 57365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttagtgatgtgtaaaa

SEQ ID NO: 57366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttagtgatgtgtaaa

SEQ ID NO: 57367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttttagtgatgtgtaa

SEQ ID NO: 57368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttatttttagtgatgt

SEQ ID NO: 57369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atataccatcataattcatt

SEQ ID NO: 57370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatataccatcataattca

SEQ ID NO: 57371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaatataccatcataatt

SEQ ID NO: 57372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctaatataccatcataat

SEQ ID NO: 57373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctctaatataccatcata

SEQ ID NO: 57374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaatataattcttctct

SEQ ID NO: 57375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataaaaatataattcttct

SEQ ID NO: 57376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctataaaaatataattcttc

SEQ ID NO: 57377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctataaaaatataattctt

SEQ ID NO: 57378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctataaaaatataattc

SEQ ID NO: 57379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcatattctttctataaa

SEQ ID NO: 57380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcagtcatattctttcta

SEQ ID NO: 57381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttagttcagtcatattc

SEQ ID NO: 57382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagttagttcagtcatatt

SEQ ID NO: 57383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaacaatatgtcttcaag

SEQ ID NO: 57384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctacaaaacaatatgtcttc

SEQ ID NO: 57385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctacaaaacaatatgtctt

SEQ ID NO: 57386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcctacaaaacaatatgt

SEQ ID NO: 57387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcctacaaaacaatatg

SEQ ID NO: 57388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcctacaaaacaatat

SEQ ID NO: 57389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatttcctacaaaacaa

SEQ ID NO: 57390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttatttcctacaaaaca

SEQ ID NO: 57391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttatttcctacaaaac

SEQ ID NO: 57392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttatttcctacaaaa

SEQ ID NO: 57393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttttattttatttcctac

SEQ ID NO: 57394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatgacctagtttttattt

SEQ ID NO: 57395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggcatgacctagttttta

SEQ ID NO: 57396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctggcatgacctagttttt

SEQ ID NO: 57397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatatttgctggcatgacc

SEQ ID NO: 57398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtaagttgtaatatttgctg

SEQ ID NO: 57399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcgtaagttgtaatatttg

SEQ ID NO: 57400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaaaagttattcgtaagt

SEQ ID NO: 57401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtagaactgagcaaaagtta

SEQ ID NO: 57402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaatctagtagaactgagc

SEQ ID NO: 57403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaatctagtagaactgag

SEQ ID NO: 57404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaaatctagtagaactga

SEQ ID NO: 57405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaattttgcaaatctagta

SEQ ID NO: 57406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaaaattttgcaaatcta

SEQ ID NO: 57407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaaaaattttgcaaatct

SEQ ID NO: 57408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagcttgttaaaaattttg

SEQ ID NO: 57409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaacaaaagataaaagcaa

SEQ ID NO: 57410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaacaaaagataaaagca

SEQ ID NO: 57411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaacaaaagataaaagc

SEQ ID NO: 57412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatatctttagaaacaaa

SEQ ID NO: 57413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatatctttagaaacaa

SEQ ID NO: 57414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatatatctttagaaaca

SEQ ID NO: 57415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatatatctttagaaac

SEQ ID NO: 57416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaatatatctttagaaa

SEQ ID NO: 57417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctttttaaatatatctt

SEQ ID NO: 57418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatctttttaaatatatct

SEQ ID NO: 57419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttgaatctttttaaatat

SEQ ID NO: 57420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcttgaatctttttaaata

SEQ ID NO: 57421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcttgaatctttttaaat

SEQ ID NO: 57422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactttagcttgaatctttt

SEQ ID NO: 57423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catcattgcactttagcttg

SEQ ID NO: 57424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaataactgcatcattgca

SEQ ID NO: 57425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagacattggtaataactg

SEQ ID NO: 57426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgagacattggtaataact

SEQ ID NO: 57427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagatttatgagacattg

SEQ ID NO: 57428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagagatttatgagacatt

SEQ ID NO: 57429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgaaaaggtaatttgaagag

SEQ ID NO: 57430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgcgaaaaggtaatttga

SEQ ID NO: 57431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctgtctgcgaaaaggtaa

SEQ ID NO: 57432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattgatctgtctgcgaa

SEQ ID NO: 57433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattaataattgatctgtct

SEQ ID NO: 57434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgagccatacctacattaat

SEQ ID NO: 57435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcgagccatacctacatta

SEQ ID NO: 57436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgcgagccatacctaca

SEQ ID NO: 57437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactctgcgagccatacct

SEQ ID NO: 57438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctattactctgcgagccat

SEQ ID NO: 57439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actccctattactctgcgag

SEQ ID NO: 57440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactccctattactctgcga

SEQ ID NO: 57441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttgactccctattactct

SEQ ID NO: 57442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcttgactccctattactc

SEQ ID NO: 57443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacttagcttgactccctat

SEQ ID NO: 57444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatgctacacttagcttga

SEQ ID NO: 57445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacaagcaatagagctca

SEQ ID NO: 57446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagttataaacaagcaata

SEQ ID NO: 57447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgcacacaggaaatgaaac

SEQ ID NO: 57448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgcacacaggaaatgaaa

SEQ ID NO: 57449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatagtatttgatgcacac

SEQ ID NO: 57450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcaatagtatttgatgca

SEQ ID NO: 57451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgcaatagtatttgatgc

SEQ ID NO: 57452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgcaatagtatttgatg

SEQ ID NO: 57453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagcagaggggattttgctg

SEQ ID NO: 57454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctagagcagaggggatttt

SEQ ID NO: 57455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catactagctagagcagagg

SEQ ID NO: 57456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagggagggagaaattacat

SEQ ID NO: 57457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaagggagggagaaattac

SEQ ID NO: 57458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcaagggagggagaaatt

SEQ ID NO: 57459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggatacatggtaatctct

SEQ ID NO: 57460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgccataacccaagcaaaat

SEQ ID NO: 57461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagataatgctatgccataa

SEQ ID NO: 57462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattgtagataatgctatg

SEQ ID NO: 57463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacattgtagataatgctat

SEQ ID NO: 57464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacattgtagataatgcta

SEQ ID NO: 57465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcacattgtagataatgc

SEQ ID NO: 57466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattctttcacattgtagat

SEQ ID NO: 57467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacaacaaagctaaattct

SEQ ID NO: 57468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaacaacaaagctaaattc

SEQ ID NO: 57469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaacaacaaagctaaatt

SEQ ID NO: 57470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaacaacaaagctaaat

SEQ ID NO: 57471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacaacaacaaagctaaa

SEQ ID NO: 57472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatacatgcaaatttttta

SEQ ID NO: 57473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacataagtgattgtgatac

SEQ ID NO: 57474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacataagtgattgtgata

SEQ ID NO: 57475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatccatttcaacataagt

SEQ ID NO: 57476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataatactgtaatccattt

SEQ ID NO: 57477 - DNA, 20 bp, synthetic construct
  source 1..20: mol_type = other DNA; note = Description ofArtificial Sequence: Synthetic oligonucleotide; note = Target: SCN9A; (-) strand; PAM type: YTN; PAM sequence: TTA
taatcactgaataatactgt

SEQ ID NO: 57478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaatagaattataatcac

SEQ ID NO: 57479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcaaaatagaattataatc

SEQ ID NO: 57480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatagccactctgcaaaat

SEQ ID NO: 57481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atagttgcaatagccactct

SEQ ID NO: 57482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactgatagttgcaatagcc

SEQ ID NO: 57483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactgatagttgcaatagc

SEQ ID NO: 57484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtactgatagttgcaatag

SEQ ID NO: 57485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtactgatagttgcaata

SEQ ID NO: 57486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggacttttgtactgatagtt

SEQ ID NO: 57487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggacttttgtactgatagt

SEQ ID NO: 57488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagcatgtaaaaggtgtaa

SEQ ID NO: 57489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatagcatgtaaaaggtgta

SEQ ID NO: 57490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttaatagcatgtaaaagg

SEQ ID NO: 57491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttatcttaatagcatgta

SEQ ID NO: 57492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgttatcttaatagcatgt

SEQ ID NO: 57493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgttatcttaatagcatg

SEQ ID NO: 57494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgttatcttaatagcat

SEQ ID NO: 57495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttttatgttatcttaat

SEQ ID NO: 57496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacttttatgttatcttaa

SEQ ID NO: 57497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaacttttatgttatct

SEQ ID NO: 57498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggccattatttcaactttta

SEQ ID NO: 57499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatactaggccattatttc

SEQ ID NO: 57500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaataattgccatactagg

SEQ ID NO: 57501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaaataattgccatacta

SEQ ID NO: 57502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtaagatattctaaaaata

SEQ ID NO: 57503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggtcattaggtaagatat

SEQ ID NO: 57504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgatggtcattaggtaaga

SEQ ID NO: 57505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagcatcaagtcctgttga

SEQ ID NO: 57506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctataagcatcaagtcctg

SEQ ID NO: 57507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctataagcatcaagtcct

SEQ ID NO: 57508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagctataagcatcaagtcc

SEQ ID NO: 57509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttagctataagcatcaag

SEQ ID NO: 57510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactttagctataagcatca

SEQ ID NO: 57511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacaaccctctactttagc

SEQ ID NO: 57512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtaattaatacaaccctct

SEQ ID NO: 57513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgagtaattaatacaacc

SEQ ID NO: 57514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctgagtaattaatacaac

SEQ ID NO: 57515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagctgagtaattaatacaa

SEQ ID NO: 57516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagctgagtaattaataca

SEQ ID NO: 57517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatttttagctgagtaatt

SEQ ID NO: 57518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accatttttagctgagtaat

SEQ ID NO: 57519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaccatttttagctgagta

SEQ ID NO: 57520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaaagtggaggtggttct

SEQ ID NO: 57521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaaagtggaggtggttc

SEQ ID NO: 57522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccaaaaagtggaggtgg

SEQ ID NO: 57523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttccaaaaagtggaggtg

SEQ ID NO: 57524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcttatttccaaaaagtgga

SEQ ID NO: 57525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaggtctagcttatttcc

SEQ ID NO: 57526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaggtctagcttatttc

SEQ ID NO: 57527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatcaggaaatatgcacat

SEQ ID NO: 57528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacaacatattaaaatcag

SEQ ID NO: 57529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaattcaaacaacatatta

SEQ ID NO: 57530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaattcaaacaacatatt

SEQ ID NO: 57531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatttatgaattcaaacaa

SEQ ID NO: 57532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatttatgaattcaaaca

SEQ ID NO: 57533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagatttatgaattcaaac

SEQ ID NO: 57534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagatttatgaattcaaa

SEQ ID NO: 57535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttgagatttatgaattc

SEQ ID NO: 57536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctacttttgagatttatga

SEQ ID NO: 57537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctacttttgagatttatg

SEQ ID NO: 57538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatttagctacttttgag

SEQ ID NO: 57539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatttagctacttttga

SEQ ID NO: 57540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgatgtggcatatacacca

SEQ ID NO: 57541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgatgtggcatatacacc

SEQ ID NO: 57542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaggtagtaaatatttagt

SEQ ID NO: 57543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcacccattggtaggtagt

SEQ ID NO: 57544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcacccattggtaggtag

SEQ ID NO: 57545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcacccattggtaggta

SEQ ID NO: 57546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtgcccaaaagagtttta

SEQ ID NO: 57547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgggtaagtataactata

SEQ ID NO: 57548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgggtaagtataactat

SEQ ID NO: 57549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgggtaagtataacta

SEQ ID NO: 57550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatatgggtaagtataa

SEQ ID NO: 57551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattttatatgggtaagtat

SEQ ID NO: 57552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctattttatatgggtaagt

SEQ ID NO: 57553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctattttatatgggtaag

SEQ ID NO: 57554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctattttatatgggtaa

SEQ ID NO: 57555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataatgacaatattttctc

SEQ ID NO: 57556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaatgttaaataatgaca

SEQ ID NO: 57557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgaatgttaaataatgac

SEQ ID NO: 57558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcatgaatgttaaataatg

SEQ ID NO: 57559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcatacaggaacaatgca

SEQ ID NO: 57560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtatcatacaggaacaatg

SEQ ID NO: 57561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctctgtatcatacaggaac

SEQ ID NO: 57562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatgtaagaacccaggct

SEQ ID NO: 57563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatgtaagaacccag

SEQ ID NO: 57564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctactaaaaatgtaagaacc

SEQ ID NO: 57565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctactaaaaatgtaagaac

SEQ ID NO: 57566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgctactaaaaatgtaa

SEQ ID NO: 57567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatggcaattaatttgcta

SEQ ID NO: 57568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagtaagagtagttagtat

SEQ ID NO: 57569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattagtagtaagagtagtt

SEQ ID NO: 57570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattagtagtaagagtagt

SEQ ID NO: 57571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatttatattagtagtaa

SEQ ID NO: 57572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaacacattgaaaatttat

SEQ ID NO: 57573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaatgactgaaaacaca

SEQ ID NO: 57574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaagaaattaaaacaatg

SEQ ID NO: 57575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgaagaaattaaaacaat

SEQ ID NO: 57576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgatagaatgagacaag

SEQ ID NO: 57577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtggttgtaatgatagaat

SEQ ID NO: 57578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatgtggttgtaatgata

SEQ ID NO: 57579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattatgtggttgtaatgat

SEQ ID NO: 57580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttcattatgtggttgtaat

SEQ ID NO: 57581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaatgaggagaagagtac

SEQ ID NO: 57582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctataaaatgaggagaaga

SEQ ID NO: 57583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctataaaatgaggagaag

SEQ ID NO: 57584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatctataaaatgaggaga

SEQ ID NO: 57585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatctataaaatgaggag

SEQ ID NO: 57586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttatctataaaatgagga

SEQ ID NO: 57587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactttcttatctataaaat

SEQ ID NO: 57588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgggcctcaactttctta

SEQ ID NO: 57589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctatatgggcctcaactt

SEQ ID NO: 57590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctatatgggcctcaact

SEQ ID NO: 57591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacctatatgggcctcaac

SEQ ID NO: 57592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaacctatatgggcctca

SEQ ID NO: 57593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatacattctttaacctata

SEQ ID NO: 57594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaatacattctttaacct

SEQ ID NO: 57595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgaatacattctttaacc

SEQ ID NO: 57596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagtttgctgaatacattc

SEQ ID NO: 57597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agccatgaccctatgagttt

SEQ ID NO: 57598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcccagttaagccatgac

SEQ ID NO: 57599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatcccagttaagccatga

SEQ ID NO: 57600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatttgtatcccagttaagc

SEQ ID NO: 57601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaactatatttgtatcccag

SEQ ID NO: 57602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agactagaactatatttgta

SEQ ID NO: 57603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagactagaactatatttg

SEQ ID NO: 57604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagcatgggttctaagact

SEQ ID NO: 57605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaggtgatatagcatacat

SEQ ID NO: 57606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaggtgatatagcataca

SEQ ID NO: 57607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaagaggtgatatagcata

SEQ ID NO: 57608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccagctcttaagaggtga

SEQ ID NO: 57609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagatgggaaagctgtacca

SEQ ID NO: 57610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagatgggaaagctgtacc

SEQ ID NO: 57611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagatgggaaagctgtac

SEQ ID NO: 57612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttacagatgggaaagct

SEQ ID NO: 57613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattttacagatgggaaag

SEQ ID NO: 57614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcattttacagatgggaaa

SEQ ID NO: 57615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcattttacagatgggaa

SEQ ID NO: 57616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcattttacagatggga

SEQ ID NO: 57617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctcattttacagatggg

SEQ ID NO: 57618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttctcattttacagatg

SEQ ID NO: 57619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctttttctcattttacag

SEQ ID NO: 57620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaccacatggagtattact

SEQ ID NO: 57621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaccacatggagtattac

SEQ ID NO: 57622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccttacaaccacatggagt

SEQ ID NO: 57623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacccttacaaccacatgga

SEQ ID NO: 57624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attctacccttacaaccaca

SEQ ID NO: 57625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcattctacccttacaac

SEQ ID NO: 57626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctcattctacccttacaa

SEQ ID NO: 57627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtagcttgtctcattctac

SEQ ID NO: 57628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtagcttgtctcattcta

SEQ ID NO: 57629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtagcttgtctcattct

SEQ ID NO: 57630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtgtagcttgtctcatt

SEQ ID NO: 57631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgtgtagcttgtctcat

SEQ ID NO: 57632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctttgtgtagcttgtc

SEQ ID NO: 57633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttctttgtgtagcttg

SEQ ID NO: 57634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctaatttctttgtgtagc

SEQ ID NO: 57635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattgttctaatttctttg

SEQ ID NO: 57636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattgtcattgttctaattt

SEQ ID NO: 57637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtattgtcattgttctaat

SEQ ID NO: 57638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attctgtattgtcattgttc

SEQ ID NO: 57639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattctgtattgtcattgtt

SEQ ID NO: 57640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgattctgtattgtcattg

SEQ ID NO: 57641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atataaattcttgattctgt

SEQ ID NO: 57642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaatataaattcttgattc

SEQ ID NO: 57643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctactaatataaattcttga

SEQ ID NO: 57644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactactaatataaattct

SEQ ID NO: 57645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctattactactaatataaat

SEQ ID NO: 57646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actactattactactaatat

SEQ ID NO: 57647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatactaactactattact

SEQ ID NO: 57648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgtcatactaactactat

SEQ ID NO: 57649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagcaaattggttgtcata

SEQ ID NO: 57650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagcaaattggttgtcat

SEQ ID NO: 57651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagcaaattggttgtca

SEQ ID NO: 57652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagcaaattggttgtc

SEQ ID NO: 57653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttttagtagcaaattgg

SEQ ID NO: 57654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatttttagtagcaaattg

SEQ ID NO: 57655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacatttttagtagcaaat

SEQ ID NO: 57656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattcttacatttttagtag

SEQ ID NO: 57657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgacacagaagtagcctg

SEQ ID NO: 57658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtatgacacagaagtagc

SEQ ID NO: 57659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcctgtatgacacagaagt

SEQ ID NO: 57660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattgttcctgtatgacaca

SEQ ID NO: 57661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggagactgcattgttcct

SEQ ID NO: 57662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttcatggagactgcattgt

SEQ ID NO: 57663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttcatggagactgcattg

SEQ ID NO: 57664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggttcatggagactgcatt

SEQ ID NO: 57665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagctttggttcatggaga

SEQ ID NO: 57666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaggtggtgtagcatacat

SEQ ID NO: 57667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaatagcattaagaggtg

SEQ ID NO: 57668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtaatagcattaagaggt

SEQ ID NO: 57669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtaatagcattaagagg

SEQ ID NO: 57670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtaatagcattaagag

SEQ ID NO: 57671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catttttgtgtaatagcatt

SEQ ID NO: 57672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccacacagcgatgtctaca

SEQ ID NO: 57673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacaggaagcaaaaatatg

SEQ ID NO: 57674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaaagggagaaaattgag

SEQ ID NO: 57675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcaaagggagaaaattga

SEQ ID NO: 57676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatccacatcaaggtttgt

SEQ ID NO: 57677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaatccacatcaaggtttg

SEQ ID NO: 57678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaaatccacatcaaggtt

SEQ ID NO: 57679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgaaatccacatcaaggt

SEQ ID NO: 57680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagtaatttcttgaaatc

SEQ ID NO: 57681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagttccaaagtaatttctt

SEQ ID NO: 57682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccgggaaacaaagacaagga

SEQ ID NO: 57683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cataagaagtgttcccggga

SEQ ID NO: 57684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgtcctccataagaagt

SEQ ID NO: 57685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaatgtcctccataagaag

SEQ ID NO: 57686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaggacagcttcaaatgtc

SEQ ID NO: 57687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaaaggacagcttcaaa

SEQ ID NO: 57688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgaaaggacagcttcaa

SEQ ID NO: 57689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattgaaaggacagcttca

SEQ ID NO: 57690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcattgaaaggacagcttc

SEQ ID NO: 57691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttcattgaaaggacagc

SEQ ID NO: 57692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttcattgaaaggacag

SEQ ID NO: 57693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttttcattgaaaggaca

SEQ ID NO: 57694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccttttcattgaaaggac

SEQ ID NO: 57695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttccttttcattgaaagga

SEQ ID NO: 57696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atagctttttccttttcatt

SEQ ID NO: 57697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacaactgatagctttttc

SEQ ID NO: 57698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataagttgcaacaactgat

SEQ ID NO: 57699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataaccataggtgggtaa

SEQ ID NO: 57700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttagaataaccataggtg

SEQ ID NO: 57701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttagaataaccataggt

SEQ ID NO: 57702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcagttagaataaccata

SEQ ID NO: 57703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttcagttagaataacca

SEQ ID NO: 57704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttcagttagaataacc

SEQ ID NO: 57705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtttcagttagaataac

SEQ ID NO: 57706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacgtattttctgtttcagt

SEQ ID NO: 57707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacgtattttctgtttcag

SEQ ID NO: 57708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttacacgtattttctgt

SEQ ID NO: 57709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaaaataaaattatgttt

SEQ ID NO: 57710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaataaaagttatacaaaa

SEQ ID NO: 57711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatataatctaagaataaa

SEQ ID NO: 57712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacattgtaatataatcta

SEQ ID NO: 57713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agactgacacattgtaatat

SEQ ID NO: 57714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagactgacacattgtaata

SEQ ID NO: 57715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttgagactgacacattg

SEQ ID NO: 57716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttatacttgagactgac

SEQ ID NO: 57717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgtagttatacttgaga

SEQ ID NO: 57718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttatattgtagttatac

SEQ ID NO: 57719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattgtagttatattgtagt

SEQ ID NO: 57720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccataaattatattgtagtt

SEQ ID NO: 57721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccataaattatattgtagt

SEQ ID NO: 57722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttgccataaattatatt

SEQ ID NO: 57723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtttgccataaattatat

SEQ ID NO: 57724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaatgtttgagtttgccat

SEQ ID NO: 57725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaatgctcaaaatgtttga

SEQ ID NO: 57726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagatctatgaatgctcaa

SEQ ID NO: 57727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagatctatgaatgctca

SEQ ID NO: 57728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatttcatagatctatga

SEQ ID NO: 57729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaatttcatagatctatg

SEQ ID NO: 57730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaaatttcatagatctat

SEQ ID NO: 57731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacaaatttcatagatct

SEQ ID NO: 57732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataggattctttacaaatt

SEQ ID NO: 57733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acataggattctttacaaat

SEQ ID NO: 57734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttacataggattctttaca

SEQ ID NO: 57735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaaaataaataaatagcc

SEQ ID NO: 57736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgaaaataaataaatagc

SEQ ID NO: 57737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttcatgaaaataaataaat

SEQ ID NO: 57738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaaaacaatcaagaattg

SEQ ID NO: 57739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggaaaacaatcaagaatt

SEQ ID NO: 57740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaggaaaacaatcaagaa

SEQ ID NO: 57741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgaggaaaacaatcaaga

SEQ ID NO: 57742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttcttgaggaaaacaatc

SEQ ID NO: 57743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatcttcttgaggaaaaca

SEQ ID NO: 57744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttattatcttcttgagga

SEQ ID NO: 57745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgttattatcttcttga

SEQ ID NO: 57746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatgttattatcttcttg

SEQ ID NO: 57747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtttattatgttattatc

SEQ ID NO: 57748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatatctgtggtttatta

SEQ ID NO: 57749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatatctgtggtttatt

SEQ ID NO: 57750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatatctgtggtttat

SEQ ID NO: 57751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaatatctgtggttta

SEQ ID NO: 57752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaatatctgtggttt

SEQ ID NO: 57753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtatgaaggccaccaattt

SEQ ID NO: 57754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacctatgtatgaaggcca

SEQ ID NO: 57755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggacctatgtatgaaggcc

SEQ ID NO: 57756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtttaggacctatgtatga

SEQ ID NO: 57757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctgggtttaggacctatg

SEQ ID NO: 57758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatggccagggaattggcc

SEQ ID NO: 57759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattaggatggccagggaat

SEQ ID NO: 57760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagaagggccaactaaatt

SEQ ID NO: 57761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagaagtgctgaaagaagg

SEQ ID NO: 57762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagaaatgttaatagaagt

SEQ ID NO: 57763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagagaaatgttaatagaag

SEQ ID NO: 57764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcagagaaatgttaatag

SEQ ID NO: 57765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatagctatttcagagaaat

SEQ ID NO: 57766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaatagctatttcagagaa

SEQ ID NO: 57767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagagtgaaaataaaatg

SEQ ID NO: 57768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaaagagtgaaaataaa

SEQ ID NO: 57769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaaaagagtgaaaataa

SEQ ID NO: 57770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattaaaaagagtgaaaata

SEQ ID NO: 57771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagctttattaaaaagagt

SEQ ID NO: 57772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatagctttattaaaaagag

SEQ ID NO: 57773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatagctttattaaaaaga

SEQ ID NO: 57774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagttttgatagctttat

SEQ ID NO: 57775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagagttttgatagcttta

SEQ ID NO: 57776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatagagttttgatagcttt

SEQ ID NO: 57777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatgattttatagagtttt

SEQ ID NO: 57778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcatgattttatagagttt

SEQ ID NO: 57779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacatcacaacccaaaatac

SEQ ID NO: 57780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaacatcacaacccaaaa

SEQ ID NO: 57781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgttgaacatcacaaccc

SEQ ID NO: 57782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgctgattgttgaacatc

SEQ ID NO: 57783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgctgattgttgaacat

SEQ ID NO: 57784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgctgattgttgaaca

SEQ ID NO: 57785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatgctgattgttgaac

SEQ ID NO: 57786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttaaatgctgattgttg

SEQ ID NO: 57787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagctgtttttaaatgctg

SEQ ID NO: 57788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgagctgtttttaaatgct

SEQ ID NO: 57789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgacttgtgagctgtttt

SEQ ID NO: 57790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtgacttgtgagctgttt

SEQ ID NO: 57791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaagatttgggtgacttg

SEQ ID NO: 57792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaagatttgggtgactt

SEQ ID NO: 57793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttgcaaaagatttgggtg

SEQ ID NO: 57794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctagtttgcaaaagatttg

SEQ ID NO: 57795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagttacctagtttgcaaa

SEQ ID NO: 57796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatagttacctagtttgcaa

SEQ ID NO: 57797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatagttacctagtttgca

SEQ ID NO: 57798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatagttacctagtttgc

SEQ ID NO: 57799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgatagttacctagtttg

SEQ ID NO: 57800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctttttgatagttacctag

SEQ ID NO: 57801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctttttgatagttaccta

SEQ ID NO: 57802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagctttttgatagttacct

SEQ ID NO: 57803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttagctttttgatagtt

SEQ ID NO: 57804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaacctaattttagcttt

SEQ ID NO: 57805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggatgaaaattagagaacct

SEQ ID NO: 57806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggatgaaaattagagaacc

SEQ ID NO: 57807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcggatgaaaattagagaac

SEQ ID NO: 57808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacacaaatctttcggatga

SEQ ID NO: 57809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacacaaatctttcggatg

SEQ ID NO: 57810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcatgagccaccatgcc

SEQ ID NO: 57811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggttacaggcatgagccac

SEQ ID NO: 57812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaacatgctggggttacag

SEQ ID NO: 57813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatgacctgccaacatgct

SEQ ID NO: 57814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtcatgacctgccaacat

SEQ ID NO: 57815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctactgtcatgacctgccaa

SEQ ID NO: 57816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgttcctactgtcatga

SEQ ID NO: 57817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagtgttcctactgtcatg

SEQ ID NO: 57818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttcaagtgttcctactgt

SEQ ID NO: 57819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggcttcaagtgttcctac

SEQ ID NO: 57820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaactcctggcttcaagtgt

SEQ ID NO: 57821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtctcaaactcctggcttca

SEQ ID NO: 57822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctagtctcaaactc

SEQ ID NO: 57823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttgcccaggctagtctca

SEQ ID NO: 57824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatgttgcccaggctagtc

SEQ ID NO: 57825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctatgttgcccaggctagt

SEQ ID NO: 57826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagataaggggtcttgctat

SEQ ID NO: 57827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagataaggggtcttgcta

SEQ ID NO: 57828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagataaggggtcttgct

SEQ ID NO: 57829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtagataaggggtcttgc

SEQ ID NO: 57830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttttgtagataaggggt

SEQ ID NO: 57831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttttgtagataagggg

SEQ ID NO: 57832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatttaaatttttgtagat

SEQ ID NO: 57833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaatatttaaatttttgt

SEQ ID NO: 57834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtacatgccaccatgcc

SEQ ID NO: 57835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agactacaggtacatgccac

SEQ ID NO: 57836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaagtagctaagactacag

SEQ ID NO: 57837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcccaagtagctaaga

SEQ ID NO: 57838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcccaagtagct

SEQ ID NO: 57839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctcccaagta

SEQ ID NO: 57840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagcaaccctcctgcctcag

SEQ ID NO: 57841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctcaagcaaccctcctgc

SEQ ID NO: 57842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgggctcaagcaaccctcct

SEQ ID NO: 57843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactctgggctcaagcaacc

SEQ ID NO: 57844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagcctcaactctgggctca

SEQ ID NO: 57845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcagcctcaactctgggct

SEQ ID NO: 57846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgcagcctcaactctggg

SEQ ID NO: 57847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtgcaatggcatgatcat

SEQ ID NO: 57848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcacccaggctagagtgcaa

SEQ ID NO: 57849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcacccaggctagagtgc

SEQ ID NO: 57850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gctctgtcacccaggctaga

SEQ ID NO: 57851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgaccaggtctcgctctg

SEQ ID NO: 57852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgaccaggtctcgctct

SEQ ID NO: 57853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtgaccaggtctcgctc

SEQ ID NO: 57854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtgaccaggtctcgct

SEQ ID NO: 57855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaagtgaccaggtctcgc

SEQ ID NO: 57856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaagtgaccaggtctcg

SEQ ID NO: 57857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacttttttaagtgacca

SEQ ID NO: 57858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaaacttttttaagtgac

SEQ ID NO: 57859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaaaacttttttaagtga

SEQ ID NO: 57860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaaaacttttttaagtg

SEQ ID NO: 57861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataaaatggaagcaaaca

SEQ ID NO: 57862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaataaaatggaagcaaac

SEQ ID NO: 57863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttagaataaaatggaagc

SEQ ID NO: 57864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacttagaataaaatggaag

SEQ ID NO: 57865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaacttaacttagaataa

SEQ ID NO: 57866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgaagaacttaacttag

SEQ ID NO: 57867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacccaacaatacagaaagg

SEQ ID NO: 57868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacacccaacaatacagaa

SEQ ID NO: 57869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attacacccaacaatacaga

SEQ ID NO: 57870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacttattacacccaacaat

SEQ ID NO: 57871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatcgctgaacttattaca

SEQ ID NO: 57872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatcgctgaacttattac

SEQ ID NO: 57873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatcgctgaacttatta

SEQ ID NO: 57874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttataatcgctgaact

SEQ ID NO: 57875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattttataatcgctgaac

SEQ ID NO: 57876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatttaaattttataatcg

SEQ ID NO: 57877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatattaatatttaaattt

SEQ ID NO: 57878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaggcactgtcatattaa

SEQ ID NO: 57879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaaggcactgtcatatta

SEQ ID NO: 57880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccttcagaaggcactgtc

SEQ ID NO: 57881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacccttcagaaggcactgt

SEQ ID NO: 57882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggtttcacccttcagaag

SEQ ID NO: 57883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactgatggtttcacccttc

SEQ ID NO: 57884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactgatggtttcaccctt

SEQ ID NO: 57885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgtactgatggtttcacc

SEQ ID NO: 57886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtttgtactgatggtttc

SEQ ID NO: 57887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgtagattactgtttgta

SEQ ID NO: 57888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgtagattactgtttgt

SEQ ID NO: 57889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatgtagattactgtttg

SEQ ID NO: 57890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttccatgtagattactgtt

SEQ ID NO: 57891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttccatgtagattactg

SEQ ID NO: 57892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacctctctttccatgtaga

SEQ ID NO: 57893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtaaaattagacctctct

SEQ ID NO: 57894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagtaaaattagacctctc

SEQ ID NO: 57895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtataagcttgaagtaaaa

SEQ ID NO: 57896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaagtataagcttgaagta

SEQ ID NO: 57897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attaagtataagcttgaagt

SEQ ID NO: 57898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagaaagagcttattaagt

SEQ ID NO: 57899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaagaaagagcttattaag

SEQ ID NO: 57900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataatatttggaagaaa

SEQ ID NO: 57901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaattaaaaataatatttg

SEQ ID NO: 57902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaattaaaaataatattt

SEQ ID NO: 57903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaattaaaaataatatt

SEQ ID NO: 57904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcaattaaaaataatat

SEQ ID NO: 57905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatcaattaaaaataata

SEQ ID NO: 57906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgactttttatcaattaaaa

SEQ ID NO: 57907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgactttttatcaattaaa

SEQ ID NO: 57908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgtgactttttatcaatt

SEQ ID NO: 57909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaatgtctacttgtgact

SEQ ID NO: 57910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggaatgtctacttgtgac

SEQ ID NO: 57911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaggaatgtctacttgt

SEQ ID NO: 57912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcaggaatgtctacttg

SEQ ID NO: 57913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgtttgtttcaggaatgtct

SEQ ID NO: 57914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgtttgtttcaggaatgtc

SEQ ID NO: 57915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatatttacgtttgtttc

SEQ ID NO: 57916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatatttacgtttgttt

SEQ ID NO: 57917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatatatttacgtttgtt

SEQ ID NO: 57918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttttatatatatttacgt

SEQ ID NO: 57919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacatggttaagtttt

SEQ ID NO: 57920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataacatggttaagttt

SEQ ID NO: 57921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataacatggttaagtt

SEQ ID NO: 57922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaataacatggttaagt

SEQ ID NO: 57923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaataacatggttaag

SEQ ID NO: 57924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaataacatggttaa

SEQ ID NO: 57925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaaataacatggtta

SEQ ID NO: 57926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaaaataacatggtt

SEQ ID NO: 57927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttttttttaaaataaca

SEQ ID NO: 57928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaactatgttttttttta

SEQ ID NO: 57929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaactatgttttttttt

SEQ ID NO: 57930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcatgaactatgtttttt

SEQ ID NO: 57931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttcatgaactatgttt

SEQ ID NO: 57932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatttcatgaactatgtt

SEQ ID NO: 57933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctatttcatgaactatgt

SEQ ID NO: 57934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctatttcatgaactatg

SEQ ID NO: 57935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcctatttcatgaactat

SEQ ID NO: 57936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttcctatttcatgaact

SEQ ID NO: 57937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttttcctatttcatga

SEQ ID NO: 57938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatatatataaagttgt

SEQ ID NO: 57939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaatatatataaagttg

SEQ ID NO: 57940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatttcaaaaatatatata

SEQ ID NO: 57941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcatttcaaaaatatatat

SEQ ID NO: 57942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagcatttcaaaaatatat

SEQ ID NO: 57943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttagcatttcaaaaatata

SEQ ID NO: 57944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttagcatttcaaaaata

SEQ ID NO: 57945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttagcatttcaaaaat

SEQ ID NO: 57946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacacaatttcttcttag

SEQ ID NO: 57947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaacaacacaatttcttct

SEQ ID NO: 57948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaacaacacaatttcttc

SEQ ID NO: 57949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttgttaacaacacaattt

SEQ ID NO: 57950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaaaataaaaaatatggg

SEQ ID NO: 57951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaaaataaaaaatatgg

SEQ ID NO: 57952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtaaaataaaaaatatg

SEQ ID NO: 57953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtaaaataaaaaatat

SEQ ID NO: 57954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttatgtaaaataaaaaa

SEQ ID NO: 57955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttatgtaaaataaaaa

SEQ ID NO: 57956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttgtttttatgtaaaata

SEQ ID NO: 57957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgccttgtttttatgta

SEQ ID NO: 57958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattgccttgtttttatgt

SEQ ID NO: 57959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattgccttgtttttatg

SEQ ID NO: 57960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacattgccttgtttttat

SEQ ID NO: 57961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtttttacattgccttgt

SEQ ID NO: 57962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatgtttttacattgcct

SEQ ID NO: 57963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattaatgtttttacattgc

SEQ ID NO: 57964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattaatgtttttacattg

SEQ ID NO: 57965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattaatgtttttacatt

SEQ ID NO: 57966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgtgtaattttctattaat

SEQ ID NO: 57967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaggttcgtgtgtaatttt

SEQ ID NO: 57968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaggttcgtgtgtaattt

SEQ ID NO: 57969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataatgtagtaagacaaga

SEQ ID NO: 57970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acataatgtagtaagacaag

SEQ ID NO: 57971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaatacttacataatgtag

SEQ ID NO: 57972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattatgaatacttacataa

SEQ ID NO: 57973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaatataactgcattatg

SEQ ID NO: 57974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactcacaaatataactgc

SEQ ID NO: 57975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaactcacaaatataactg

SEQ ID NO: 57976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaaactcacaaatataa

SEQ ID NO: 57977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccgttatttcaaactcacaa

SEQ ID NO: 57978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatctaccgttatttcaaac

SEQ ID NO: 57979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcaatctaccgttattt

SEQ ID NO: 57980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattcaatctaccgttatt

SEQ ID NO: 57981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgaattcaatctaccg

SEQ ID NO: 57982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatttgaattcaatctacc

SEQ ID NO: 57983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatcaccttaaatttgaat

SEQ ID NO: 57984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatcaccttaaatttgaa

SEQ ID NO: 57985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatttaacatcaccttaa

SEQ ID NO: 57986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaagaatttaacatcac

SEQ ID NO: 57987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacattcaattaagaatt

SEQ ID NO: 57988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatacattcaattaagaat

SEQ ID NO: 57989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatacattcaattaagaa

SEQ ID NO: 57990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatacattcaattaaga

SEQ ID NO: 57991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagatttttaaatacattc

SEQ ID NO: 57992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcagatttttaaatacatt

SEQ ID NO: 57993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttatcagatttttaaat

SEQ ID NO: 57994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaaaatatattacattta

SEQ ID NO: 57995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtagggacctatacaaaat

SEQ ID NO: 57996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtagggacctatacaaaa

SEQ ID NO: 57997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatttaagtagggaccta

SEQ ID NO: 57998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataatttaagtagggacct

SEQ ID NO: 57999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataatttaagtagggacc

SEQ ID NO: 58000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaataggttttgataattt

SEQ ID NO: 58001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggaaataggttttgataa

SEQ ID NO: 58002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaagcctgttggaaatagg

SEQ ID NO: 58003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacatacctaccaagcctg

SEQ ID NO: 58004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcacatacctaccaagcct

SEQ ID NO: 58005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcacatacctaccaagcc

SEQ ID NO: 58006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catagatcattttatcacat

SEQ ID NO: 58007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgagactacatagatcattt

SEQ ID NO: 58008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgagactacatagatcatt

SEQ ID NO: 58009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgagactacatagatcat

SEQ ID NO: 58010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatgaaagacaccatgcag

SEQ ID NO: 58011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatgaaagacaccatgca

SEQ ID NO: 58012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaatatgaaagacacca

SEQ ID NO: 58013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttaatatgaaagacacc

SEQ ID NO: 58014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttaatatgaaagacac

SEQ ID NO: 58015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatttaatatgaaagaca

SEQ ID NO: 58016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaatttaatatgaaagac

SEQ ID NO: 58017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaccactttttaatttaata

SEQ ID NO: 58018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaccactttttaatttaat

SEQ ID NO: 58019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgaaccactttttaattt

SEQ ID NO: 58020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctatttgaaccacttttt

SEQ ID NO: 58021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggctatttgaaccactttt

SEQ ID NO: 58022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttaggctatttgaacca

SEQ ID NO: 58023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcatcttaggctatttga

SEQ ID NO: 58024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttcattcatcttaggcta

SEQ ID NO: 58025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggttcattcatcttaggct

SEQ ID NO: 58026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccatcttaggttcattca

SEQ ID NO: 58027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataccatcttaggttcattc

SEQ ID NO: 58028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataccatcttaggttcatt

SEQ ID NO: 58029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttataccatcttaggttca

SEQ ID NO: 58030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagattctttataccatctt

SEQ ID NO: 58031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggctaaagattctttatac

SEQ ID NO: 58032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatctagggctaaagattct

SEQ ID NO: 58033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgtataaaactcaatctagg

SEQ ID NO: 58034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctacgtataaaactcaat

SEQ ID NO: 58035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctaatctacgtataaaac

SEQ ID NO: 58036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcctaatctacgtataaaa

SEQ ID NO: 58037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacatttgtcctaatctac

SEQ ID NO: 58038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacatttgtcctaatcta

SEQ ID NO: 58039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagacatttgtcctaatct

SEQ ID NO: 58040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgagacatttgtcctaa

SEQ ID NO: 58041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactttgagacatttgtcc

SEQ ID NO: 58042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacatccgttattactttg

SEQ ID NO: 58043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaacatccgttattacttt

SEQ ID NO: 58044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaacatccgttattactt

SEQ ID NO: 58045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatatattttacaacatcc

SEQ ID NO: 58046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtgatatattttacaa

SEQ ID NO: 58047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattgtgatatattttaca

SEQ ID NO: 58048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattgtgatatattttac

SEQ ID NO: 58049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaattgtgatatatttta

SEQ ID NO: 58050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaatgtttttaaattgtgat

SEQ ID NO: 58051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaatgagatcagaagtct

SEQ ID NO: 58052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggttaaagaatgagatcag

SEQ ID NO: 58053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggttaaagaatgagatca

SEQ ID NO: 58054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaaacaaagatttatggt

SEQ ID NO: 58055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacgtacctatagaaacaaa

SEQ ID NO: 58056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacgtacctatagaaacaa

SEQ ID NO: 58057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagaaagaggatttaaac

SEQ ID NO: 58058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaagaaagaggatttaaa

SEQ ID NO: 58059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaatttaaaaagaaagagg

SEQ ID NO: 58060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggcaatttaaaaagaaaga

SEQ ID NO: 58061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctggcaatttaaaaagaa

SEQ ID NO: 58062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttctggcaatttaaaaa

SEQ ID NO: 58063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgttctggcaatttaaaa

SEQ ID NO: 58064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgttctggcaatttaaa

SEQ ID NO: 58065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgttctggcaatttaa

SEQ ID NO: 58066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttgttctggcaattta

SEQ ID NO: 58067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcacatattttttgttgt

SEQ ID NO: 58068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcacatattttttgttg

SEQ ID NO: 58069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataataaatgtttaaagca

SEQ ID NO: 58070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataataaatgtttaaagc

SEQ ID NO: 58071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttatataataaatgttt

SEQ ID NO: 58072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaataataaattacattt

SEQ ID NO: 58073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaataataaattacatt

SEQ ID NO: 58074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatttaaaaaataataaa

SEQ ID NO: 58075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatatttaaaaaataataa

SEQ ID NO: 58076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatatttaaaaaataata

SEQ ID NO: 58077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttccatatttaaaaaata

SEQ ID NO: 58078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctttccatatttaaaaaat

SEQ ID NO: 58079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttgctttccatatttaaa

SEQ ID NO: 58080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaatttgctttccatatt

SEQ ID NO: 58081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactaatttgctttccatat

SEQ ID NO: 58082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcactaatttgctttccata

SEQ ID NO: 58083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcaaatatataaaacaac

SEQ ID NO: 58084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagcaaatatataaaacaa

SEQ ID NO: 58085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagcaaatatataaaaca

SEQ ID NO: 58086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggaggttttgaagcaaat

SEQ ID NO: 58087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgggaggttttgaagcaaa

SEQ ID NO: 58088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgggaggttttgaagcaa

SEQ ID NO: 58089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgggaggttttgaagca

SEQ ID NO: 58090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagatttttgtgggaggtt

SEQ ID NO: 58091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaagatttttgtgggaggt

SEQ ID NO: 58092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttagaagatttttgtggga

SEQ ID NO: 58093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttagaagatttttgtggg

SEQ ID NO: 58094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttagaagatttttgtgg

SEQ ID NO: 58095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaggtagaatgtagtttt

SEQ ID NO: 58096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctacacaggtagaatgta

SEQ ID NO: 58097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcacaggcaaaaattgag

SEQ ID NO: 58098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatgcacaggcaaaaatt

SEQ ID NO: 58099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagttattcatgcacagg

SEQ ID NO: 58100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataaagttattcatgcaca

SEQ ID NO: 58101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctataaagttattcatgcac

SEQ ID NO: 58102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctataaagttattcatgc

SEQ ID NO: 58103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctataaagttattcatg

SEQ ID NO: 58104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttctataaagttattcat

SEQ ID NO: 58105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaatatgagatctttctt

SEQ ID NO: 58106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggaatatgagatctttct

SEQ ID NO: 58107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaggaatatgagatctt

SEQ ID NO: 58108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcaggaatatgagatct

SEQ ID NO: 58109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgagtttatttcaggaata

SEQ ID NO: 58110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtgagtttatttcaggaat

SEQ ID NO: 58111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgtgagtttatttcaggaa

SEQ ID NO: 58112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgtgagtttatttcagga

SEQ ID NO: 58113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcgtgagtttatttcagg

SEQ ID NO: 58114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcgtgagtttatttcag

SEQ ID NO: 58115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttcgtgagtttatttca

SEQ ID NO: 58116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagaaataaccataatgc

SEQ ID NO: 58117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaagaaataaccataatg

SEQ ID NO: 58118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagtaatttgaaaagaaat

SEQ ID NO: 58119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatagtaatttgaaaaga

SEQ ID NO: 58120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaacacctattaatagtaa

SEQ ID NO: 58121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaacacctattaatagta

SEQ ID NO: 58122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaacacctattaatagt

SEQ ID NO: 58123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaaacacctattaatag

SEQ ID NO: 58124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaaaacacctattaata

SEQ ID NO: 58125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttttgaaaacacctatt

SEQ ID NO: 58126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagacatctagttttttgaa

SEQ ID NO: 58127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgtagacatctagttttt

SEQ ID NO: 58128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattagctgtagacatctag

SEQ ID NO: 58129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattagctgtagacatcta

SEQ ID NO: 58130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcattagctgtagacatct

SEQ ID NO: 58131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgcattagctgtagac

SEQ ID NO: 58132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaagcacatattcattttg

SEQ ID NO: 58133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaagcacatattcatttt

SEQ ID NO: 58134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttatcaagcacatattca

SEQ ID NO: 58135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttatcaagcacatatt

SEQ ID NO: 58136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaatttatcaagcacatat

SEQ ID NO: 58137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatcaacacagtaccatggg

SEQ ID NO: 58138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcaatcaacacagtacca

SEQ ID NO: 58139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctcaatcaacacagtacc

SEQ ID NO: 58140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcctcaatcaacacagtac

SEQ ID NO: 58141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatgtgaaatatattttgc

SEQ ID NO: 58142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgatgtgaaatatatttt

SEQ ID NO: 58143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattctatgatgtgaaata

SEQ ID NO: 58144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaattctatgatgtgaaat

SEQ ID NO: 58145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaaaattctatgatgtga

SEQ ID NO: 58146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccttaaaattctatgatgt

SEQ ID NO: 58147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccttaaaattctatgatg

SEQ ID NO: 58148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgtatacaatgaggaaga

SEQ ID NO: 58149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatgtatacaatgaggaag

SEQ ID NO: 58150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatatacttcaatgtataca

SEQ ID NO: 58151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatatacttcaatgtatac

SEQ ID NO: 58152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggatatacttcaatgtata

SEQ ID NO: 58153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggatatacttcaatgtat

SEQ ID NO: 58154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggatatacttcaatgta

SEQ ID NO: 58155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttggatatacttcaatgt

SEQ ID NO: 58156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaagtaatcttttttgga

SEQ ID NO: 58157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattatggaagtaatctttt

SEQ ID NO: 58158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaattatggaagtaatct

SEQ ID NO: 58159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaaattatggaagtaatc

SEQ ID NO: 58160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctaaattatggaagtaat

SEQ ID NO: 58161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttcctaaattatggaagt

SEQ ID NO: 58162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttcctaaattatggaag

SEQ ID NO: 58163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaccaacttactttcctaa

SEQ ID NO: 58164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaccaacttactttccta

SEQ ID NO: 58165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgccaccaacttactttcc

SEQ ID NO: 58166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgccaccaacttacttt

SEQ ID NO: 58167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctcttgccaccaacttac

SEQ ID NO: 58168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctctcttgccaccaactta

SEQ ID NO: 58169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaacttgctctcttgccac

SEQ ID NO: 58170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaacttgctctcttgcca

SEQ ID NO: 58171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgccaacttgctctcttgc

SEQ ID NO: 58172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatagggattcttgccaac

SEQ ID NO: 58173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatgaataaaaaagcattg

SEQ ID NO: 58174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatgaataaaaaagcatt

SEQ ID NO: 58175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacagatatgtgtttagtat

SEQ ID NO: 58176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacagatatgtgtttagta

SEQ ID NO: 58177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacacagatatgtgtttagt

SEQ ID NO: 58178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatcatgtaatatgacaga

SEQ ID NO: 58179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatcatgtaatatgacag

SEQ ID NO: 58180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaatcatgtaatatgaca

SEQ ID NO: 58181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaagctttcaaatcatgta

SEQ ID NO: 58182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaagctttcaaatcatgt

SEQ ID NO: 58183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatacaatcccgtgtttggc

SEQ ID NO: 58184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatacaatcccgtgtttgg

SEQ ID NO: 58185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcacttgtatacaatccc

SEQ ID NO: 58186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcatcacttgtatacaat

SEQ ID NO: 58187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcatcacttgtatacaa

SEQ ID NO: 58188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcacagtatttattgcatc

SEQ ID NO: 58189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggcacagtatttattgcat

SEQ ID NO: 58190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcagataataacttgggca

SEQ ID NO: 58191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcagataataacttgggc

SEQ ID NO: 58192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accacggtacatacttgagc

SEQ ID NO: 58193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaccacggtacatacttgag

SEQ ID NO: 58194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgaccacggtacatactt

SEQ ID NO: 58195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgtttgaccacggtacat

SEQ ID NO: 58196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatgcagttagttgtttga

SEQ ID NO: 58197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatatgcagttagttgtt

SEQ ID NO: 58198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgatatgcagttagttgt

SEQ ID NO: 58199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaaatccttcctgatatg

SEQ ID NO: 58200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagcaaagttgatgaaatc

SEQ ID NO: 58201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctgtaagcaaagttgatga

SEQ ID NO: 58202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgctgtaagcaaagttgatg

SEQ ID NO: 58203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcgctgtaagcaaagttgat

SEQ ID NO: 58204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatcctttcgctgtaagc

SEQ ID NO: 58205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcatcctttcgctgtaag

SEQ ID NO: 58206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagtcatcctttcgctgt

SEQ ID NO: 58207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcagtattgtttagtcatc

SEQ ID NO: 58208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgcagtattgtttagtcat

SEQ ID NO: 58209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatgcagtattgtttagtc

SEQ ID NO: 58210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatgcagtattgtttagt

SEQ ID NO: 58211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttatgcagtattgtttag

SEQ ID NO: 58212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttcttatgcagtattgtt

SEQ ID NO: 58213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctttcttatgcagtatt

SEQ ID NO: 58214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctttcttatgcagtat

SEQ ID NO: 58215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgctttcttatgcagta

SEQ ID NO: 58216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaattttcctgctttctt

SEQ ID NO: 58217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaaattttcctgctttct

SEQ ID NO: 58218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcaaattttcctgctttc

SEQ ID NO: 58219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtcaaattttcctgcttt

SEQ ID NO: 58220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttgtcaaattttcctgct

SEQ ID NO: 58221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactcttttgtcaaattttc

SEQ ID NO: 58222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaactcttttgtcaaatttt

SEQ ID NO: 58223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaactcttttgtcaaatt

SEQ ID NO: 58224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatagtctcttaaactct

SEQ ID NO: 58225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccaaaatactgataatagt

SEQ ID NO: 58226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctgcccaaaatactgata

SEQ ID NO: 58227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actgtgctgcccaaaatact

SEQ ID NO: 58228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactgtgctgcccaaaatac

SEQ ID NO: 58229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatttgactgtgctgccca

SEQ ID NO: 58230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catagcctaacatttgactg

SEQ ID NO: 58231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatagcctaacatttgact

SEQ ID NO: 58232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttacatagcctaacatttg

SEQ ID NO: 58233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatttacatagcctaacat

SEQ ID NO: 58234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattatttacatagcctaa

SEQ ID NO: 58235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattatttacatagccta

SEQ ID NO: 58236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgctattatttacatagc

SEQ ID NO: 58237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttgctattatttacata

SEQ ID NO: 58238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagaagttctatttgctat

SEQ ID NO: 58239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacagaagttctatttgc

SEQ ID NO: 58240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaaaaagttattgacaga

SEQ ID NO: 58241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaaacaaagataactg

SEQ ID NO: 58242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaaaaaaaacaaagataa

SEQ ID NO: 58243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactcctcaaaaaaaacaaa

SEQ ID NO: 58244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtacatattacactcctca

SEQ ID NO: 58245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagtacatattacactcct

SEQ ID NO: 58246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctaagtacatattacact

SEQ ID NO: 58247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaattattctaagtacat

SEQ ID NO: 58248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaaattattctaagtaca

SEQ ID NO: 58249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagaataaccacagaactt

SEQ ID NO: 58250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatagaataaccacagaa

SEQ ID NO: 58251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcatagaataaccacaga

SEQ ID NO: 58252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttcatagaataaccacag

SEQ ID NO: 58253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttcatagaataaccaca

SEQ ID NO: 58254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgttcatagaataaccac

SEQ ID NO: 58255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatccctttttgttcatag

SEQ ID NO: 58256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatccctttttgttcata

SEQ ID NO: 58257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatatccctttttgttcat

SEQ ID NO: 58258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatatccctttttgttc

SEQ ID NO: 58259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttcatatccctttttgtt

SEQ ID NO: 58260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctttcatatccctttttg

SEQ ID NO: 58261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctttcatatcccttttt

SEQ ID NO: 58262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttctttcatatccctttt

SEQ ID NO: 58263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagcctttcttctttcata

SEQ ID NO: 58264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagcctttcttctttcat

SEQ ID NO: 58265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttcatagcctttcttct

SEQ ID NO: 58266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtattgtgtttcatagcc

SEQ ID NO: 58267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtattgtgtttcatagc

SEQ ID NO: 58268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagagtattgtgtttcatag

SEQ ID NO: 58269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttagagtattgtgtttc

SEQ ID NO: 58270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctttagagtattgtgttt

SEQ ID NO: 58271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatgccaacaaggataaga

SEQ ID NO: 58272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcacatgccaacaaggat

SEQ ID NO: 58273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactcacatgccaacaagga

SEQ ID NO: 58274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttgactcacatgccaac

SEQ ID NO: 58275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcatcttgactcacatgc

SEQ ID NO: 58276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcatcttgactcacatg

SEQ ID NO: 58277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattcatcttgactcacat

SEQ ID NO: 58278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattcatcttgactcaca

SEQ ID NO: 58279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaatgtttttcattcatct

SEQ ID NO: 58280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaatgtttttcattcat

SEQ ID NO: 58281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacaaatgtttttcattca

SEQ ID NO: 58282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttctacaaatgtttttca

SEQ ID NO: 58283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcatttctacaaatgtttt

SEQ ID NO: 58284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatatatgtaggctattc

SEQ ID NO: 58285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaatgccatgggattaaa

SEQ ID NO: 58286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtgcctataaaatgcca

SEQ ID NO: 58287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgtgcctataaaatgcc

SEQ ID NO: 58288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcagaaccaatttatatg

SEQ ID NO: 58289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattgcatcagaaccaattt

SEQ ID NO: 58290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacattgcatcagaaccaat

SEQ ID NO: 58291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctacattgcatcagaacc

SEQ ID NO: 58292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctacattgcatcagaac

SEQ ID NO: 58293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttattctacattgcatc

SEQ ID NO: 58294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatttattctacattgcat

SEQ ID NO: 58295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtgcttaaatttattcta

SEQ ID NO: 58296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggtgcttaaatttattct

SEQ ID NO: 58297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggtgcttaaatttattc

SEQ ID NO: 58298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttgaggtgcttaaatt

SEQ ID NO: 58299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattttgaggtgcttaaa

SEQ ID NO: 58300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctatattttgaggtgctt

SEQ ID NO: 58301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaatgtacagaggttattc

SEQ ID NO: 58302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaatgtacagaggttatt

SEQ ID NO: 58303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaatgtacagaggttat

SEQ ID NO: 58304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcaatgtacagaggtta

SEQ ID NO: 58305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatcaatgtacagaggtt

SEQ ID NO: 58306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttatcaatgtacaga

SEQ ID NO: 58307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactttttatcaatgtacag

SEQ ID NO: 58308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggagcttgactttttatca

SEQ ID NO: 58309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagggagcttgacttttta

SEQ ID NO: 58310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgcattattagggagct

SEQ ID NO: 58311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaaaatgcattattaggg

SEQ ID NO: 58312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttaaaatgcattattagg

SEQ ID NO: 58313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaatgtttagttaaaatgc

SEQ ID NO: 58314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatgaatgtttagttaaa

SEQ ID NO: 58315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagaagtaatggacattag

SEQ ID NO: 58316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatagaagtaatggacatta

SEQ ID NO: 58317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatgaaatgcttgatagaa

SEQ ID NO: 58318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatgaaatgcttgataga

SEQ ID NO: 58319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcaatgaaatgcttgatag

SEQ ID NO: 58320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctttgcaatgaaatgcttg

SEQ ID NO: 58321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctttgcaatgaaatgctt

SEQ ID NO: 58322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttggctttgcaatgaaat

SEQ ID NO: 58323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccttggctttgcaatgaaa

SEQ ID NO: 58324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaatcaacaaaagtatttg

SEQ ID NO: 58325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaatcaacaaaagtattt

SEQ ID NO: 58326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttggaaatcaacaaaagta

SEQ ID NO: 58327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatttggaaatcaacaaaa

SEQ ID NO: 58328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctattatttggaaatcaac

SEQ ID NO: 58329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctattatttggaaatcaa

SEQ ID NO: 58330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatctattatttggaaat

SEQ ID NO: 58331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatttatctattatttgga

SEQ ID NO: 58332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgtaaataaacaacaca

SEQ ID NO: 58333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatgtaaataaacaacac

SEQ ID NO: 58334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcccatgtaaataaacaa

SEQ ID NO: 58335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttcccatgtaaataaaca

SEQ ID NO: 58336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcttgtttcccatgtaaat

SEQ ID NO: 58337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattagtcttgtttcccat

SEQ ID NO: 58338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaggattgtaattagtctt

SEQ ID NO: 58339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaggattgtaattagtct

SEQ ID NO: 58340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacaggattgtaattagtc

SEQ ID NO: 58341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcacaggattgtaattagt

SEQ ID NO: 58342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatcttttcacaggattgt

SEQ ID NO: 58343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcatcttttcacaggattg

SEQ ID NO: 58344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttgtcatcttttcacagg

SEQ ID NO: 58345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctgccttgtcatctttt

SEQ ID NO: 58346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatctgccttgtcatcttt

SEQ ID NO: 58347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatctgccttgtcatctt

SEQ ID NO: 58348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacatctgccttgtcatct

SEQ ID NO: 58349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaatcagaagaccatgta

SEQ ID NO: 58350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaatcagaagaccatgt

SEQ ID NO: 58351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataaatcagaagaccatg

SEQ ID NO: 58352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaataaatcagaagaccat

SEQ ID NO: 58353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttttaataaatcagaaga

SEQ ID NO: 58354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttttaataaatcagaag

SEQ ID NO: 58355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtttttaataaatcagaa

SEQ ID NO: 58356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtttttaataaatcaga

SEQ ID NO: 58357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggtttttaataaatcag

SEQ ID NO: 58358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttttttggtttttaataa

SEQ ID NO: 58359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcatacaaaagtgattca

SEQ ID NO: 58360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attatagcatacaaaagtga

SEQ ID NO: 58361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgattatagcatacaaaag

SEQ ID NO: 58362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggaattattgattatagc

SEQ ID NO: 58363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtaggaattattgattata

SEQ ID NO: 58364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatcgtaagagaactctg

SEQ ID NO: 58365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaatcgtaagagaactct

SEQ ID NO: 58366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagaatcgtaagagaactc

SEQ ID NO: 58367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaagaatcgtaagagaac

SEQ ID NO: 58368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgattctttaagaatcgta

SEQ ID NO: 58369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactgatgattctttaagaa

SEQ ID NO: 58370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcactgatgattctttaaga

SEQ ID NO: 58371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcactgatgattctttaag

SEQ ID NO: 58372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcactgatgattctttaa

SEQ ID NO: 58373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgcactgatgattctt

SEQ ID NO: 58374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagatggttatttttgcac

SEQ ID NO: 58375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaaggtgggcagcattag

SEQ ID NO: 58376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaagaaaggtgggcagcat

SEQ ID NO: 58377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaagaaaggtgggcagca

SEQ ID NO: 58378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttcctaagaaaggtgggc

SEQ ID NO: 58379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatttcctaagaaaggtgg

SEQ ID NO: 58380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actctgatttcctaagaaag

SEQ ID NO: 58381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaaggcagtgcagtcactaa

SEQ ID NO: 58382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgaaggcagtgcagtcact

SEQ ID NO: 58383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaatattctcgaaggca

SEQ ID NO: 58384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaaaatattctcgaaggc

SEQ ID NO: 58385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaaaatattctcgaagg

SEQ ID NO: 58386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcaaaatattctcgaag

SEQ ID NO: 58387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatcaaaatattctcgaa

SEQ ID NO: 58388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgccaaaatcctttttatca

SEQ ID NO: 58389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaagtctatgccaaaatc

SEQ ID NO: 58390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggaagtctatgccaaaat

SEQ ID NO: 58391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggaagtctatgccaaaa

SEQ ID NO: 58392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaggaagtctatgccaaa

SEQ ID NO: 58393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttgaggaagtctatgcca

SEQ ID NO: 58394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaactcttttgaggaag

SEQ ID NO: 58395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttaataaaactcttttga

SEQ ID NO: 58396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgttaataaaactcttttg

SEQ ID NO: 58397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtgttaataaaactctt

SEQ ID NO: 58398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtgttaataaaactct

SEQ ID NO: 58399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaagtgatttatttgtgt

SEQ ID NO: 58400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcctgtgaaagtgattta

SEQ ID NO: 58401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcctgtgaaagtgattt

SEQ ID NO: 58402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacagcctgtgaaagtga

SEQ ID NO: 58403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatattgtttacagcctgt

SEQ ID NO: 58404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatattgtttacagcctg

SEQ ID NO: 58405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatatattgtttacagcct

SEQ ID NO: 58406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatatattgtttacagcc

SEQ ID NO: 58407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttgatatattgtttac

SEQ ID NO: 58408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttttgatatattgttta

SEQ ID NO: 58409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgatagtgtaacaaagc

SEQ ID NO: 58410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catatgatagtgtaacaaag

SEQ ID NO: 58411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccttcatatgatagtgta

SEQ ID NO: 58412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaccttcatatgatagtg

SEQ ID NO: 58413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccaccacctctccacctt

SEQ ID NO: 58414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catccaccacctctccacct

SEQ ID NO: 58415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtccagaaaaaacagatg

SEQ ID NO: 58416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgagaactcaagtccagaa

SEQ ID NO: 58417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatgttaatgagaactca

SEQ ID NO: 58418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataatgttaatgagaactc

SEQ ID NO: 58419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataatgttaatgagaact

SEQ ID NO: 58420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgataatgttaatgagaac

SEQ ID NO: 58421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aataaaaaagatatggcttt

SEQ ID NO: 58422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaataaaaaagatatggc

SEQ ID NO: 58423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcaataaaaaagatatgg

SEQ ID NO: 58424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcaaaatgtcaaaaatat

SEQ ID NO: 58425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggcaaaatgtcaaaaata

SEQ ID NO: 58426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccgcttaaggcaaaatgtca

SEQ ID NO: 58427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagacgttaccgcttaaggc

SEQ ID NO: 58428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagacgttaccgcttaagg

SEQ ID NO: 58429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcgtgcttatagacgttac

SEQ ID NO: 58430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcattcagcgtgcttataga

SEQ ID NO: 58431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtcattcagcgtgcttat

SEQ ID NO: 58432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctactgtcattcagcgtgct

SEQ ID NO: 58433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacggaaacaagaggatgt

SEQ ID NO: 58434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaacccatcacaaccacac

SEQ ID NO: 58435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagtgtcctatgaaccca

SEQ ID NO: 58436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaagtgtcctatgaaccc

SEQ ID NO: 58437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaatccttccaaagtgtcc

SEQ ID NO: 58438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtctgcaaatccttccaa

SEQ ID NO: 58439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagatggaagaaaggttca

SEQ ID NO: 58440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttcacagatggaagaaagg

SEQ ID NO: 58441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgttcacagatggaagaaag

SEQ ID NO: 58442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcgttcacagatggaagaa

SEQ ID NO: 58443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcgttcacagatggaag

SEQ ID NO: 58444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgagagtggggagatgga

SEQ ID NO: 58445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtgagagtggggagatgg

SEQ ID NO: 58446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggtgagagtggggagatg

SEQ ID NO: 58447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagcgtgttttgggtgag

SEQ ID NO: 58448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaagcgtgttttgggtga

SEQ ID NO: 58449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaagcgtgttttgggtg

SEQ ID NO: 58450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacaaagcgtgttttgggt

SEQ ID NO: 58451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttacaaagcgtgttttg

SEQ ID NO: 58452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttacaaagcgtgtttt

SEQ ID NO: 58453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcttttacaaagcgtgt

SEQ ID NO: 58454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttgcttttacaaagcgtg

SEQ ID NO: 58455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatcttatttgcttttaca

SEQ ID NO: 58456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacatcttatttgcttttac

SEQ ID NO: 58457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttgacatcttatttgctt

SEQ ID NO: 58458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggtgaccggatccattgt

SEQ ID NO: 58459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccatggttagtggtgaccg

SEQ ID NO: 58460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatggatctgcccatggtt

SEQ ID NO: 58461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgccatggatctgcccat

SEQ ID NO: 58462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagcaaaacccaacaaagt

SEQ ID NO: 58463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatagcaaaacccaacaaa

SEQ ID NO: 58464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcatagcaaaacccaacaa

SEQ ID NO: 58465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctcatagcaaaacccaac

SEQ ID NO: 58466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcttctcatagcaaaaccc

SEQ ID NO: 58467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcctcctcttctcatagc

SEQ ID NO: 58468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctggatcctcctcttctc

SEQ ID NO: 58469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagctgccctggatcctcct

SEQ ID NO: 58470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagctgccctggatcctcc

SEQ ID NO: 58471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcagctgccctggatcctc

SEQ ID NO: 58472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttgcagctgccctggat

SEQ ID NO: 58473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgattttgcagctgccctgg

SEQ ID NO: 58474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgattttgcagctgccct

SEQ ID NO: 58475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactctctgattttgcagct

SEQ ID NO: 58476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaactctctgattttgcag

SEQ ID NO: 58477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaaactctctgattttgc

SEQ ID NO: 58478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagttctctaaactctct

SEQ ID NO: 58479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagagttctctaaactctc

SEQ ID NO: 58480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcccgatgcgacccagttt

SEQ ID NO: 58481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcccgatgcgacccagtt

SEQ ID NO: 58482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagaagtttgatcccgatg

SEQ ID NO: 58483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggagaagtttgatcccgat

SEQ ID NO: 58484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaggtttgggagaagtttg

SEQ ID NO: 58485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgaggtttgggagaagtt

SEQ ID NO: 58486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatgttctatgaggtttgg

SEQ ID NO: 58487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatgttctatgaggtttg

SEQ ID NO: 58488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagatgttctatgaggttt

SEQ ID NO: 58489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtgaggatgactttgagat

SEQ ID NO: 58490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgagtgaggatgactttgag

SEQ ID NO: 58491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacctctgagtgaggatgac

SEQ ID NO: 58492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaaagtactgaacctctg

SEQ ID NO: 58493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccactgaagaaagtactgaa

SEQ ID NO: 58494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttgccactgaagaaagt

SEQ ID NO: 58495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgttgccactgaagaaag

SEQ ID NO: 58496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgttgccactgaagaaa

SEQ ID NO: 58497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaattttagtgttgccac

SEQ ID NO: 58498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtcatactggagaatttt

SEQ ID NO: 58499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtgaacatgtacattgca

SEQ ID NO: 58500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttgtggtgaacatgtacat

SEQ ID NO: 58501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggttgtggtgaacatgta

SEQ ID NO: 58502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctggttgtggtgaacatgt

SEQ ID NO: 58503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcatcatatccttcctgg

SEQ ID NO: 58504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatatcatcatatccttc

SEQ ID NO: 58505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagttatatcatcatatcc

SEQ ID NO: 58506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttagttatatcatcatatc

SEQ ID NO: 58507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttagttatatcatcatat

SEQ ID NO: 58508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttgttagttatatcatca

SEQ ID NO: 58509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactttgttagttatatcat

SEQ ID NO: 58510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatattctactttgttagt

SEQ ID NO: 58511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggaatattctactttgtt

SEQ ID NO: 58512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtaacccatctgttggaa

SEQ ID NO: 58513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggagactgtggtaaccca

SEQ ID NO: 58514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttgaaggagactgtggta

SEQ ID NO: 58515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagttcagttgaaggagac

SEQ ID NO: 58516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcctggaagttcagttgaa

SEQ ID NO: 58517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacccaaaaaaagttcatc

SEQ ID NO: 58518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagtaagccacccgactgt

SEQ ID NO: 58519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacagtaagccacccgactg

SEQ ID NO: 58520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaacagtaagccacccgac

SEQ ID NO: 58521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcttaacagtaagccaccc

SEQ ID NO: 58522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcacctattcttaacagtaa

SEQ ID NO: 58523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctagcacctattcttaacag

SEQ ID NO: 58524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatggattgctagcaccta

SEQ ID NO: 58525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgggatggattgctagca

SEQ ID NO: 58526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggctgggatggattgcta

SEQ ID NO: 58527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctggctgggatggattgc

SEQ ID NO: 58528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacctctgctggctgggat

SEQ ID NO: 58529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaattacaacctctgctgg

SEQ ID NO: 58530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttccaaattacaacctctgc

SEQ ID NO: 58531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgttccaaattacaacct

SEQ ID NO: 58532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctgttccaaattacaacc

SEQ ID NO: 58533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaacagtatgatttgcctg

SEQ ID NO: 58534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaacagtatgatttgcct

SEQ ID NO: 58535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggcaacagtatgatttgcc

SEQ ID NO: 58536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacctttggcaacagtatg

SEQ ID NO: 58537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacctttggcaacagtat

SEQ ID NO: 58538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacctttggcaacagta

SEQ ID NO: 58539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttgagacctttggcaa

SEQ ID NO: 58540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgacatgttcaattttgag

SEQ ID NO: 58541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaggaagatggaattaat

SEQ ID NO: 58542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttaaaaaggaagatggaa

SEQ ID NO: 58543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctatgttaaaaaggaagat

SEQ ID NO: 58544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctatgttaaaaaggaaga

SEQ ID NO: 58545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcctatgttaaaaaggaag

SEQ ID NO: 58546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatgtccaactttgcctat

SEQ ID NO: 58547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatgtccaactttgccta

SEQ ID NO: 58548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaatgtccaactttgcct

SEQ ID NO: 58549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgccatctttggaatgtcca

SEQ ID NO: 58550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctacgccatctttggaat

SEQ ID NO: 58551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcatgttcatctacgccat

SEQ ID NO: 58552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggtcatgttcatctacgc

SEQ ID NO: 58553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctggtcatgttcatctacg

SEQ ID NO: 58554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctggtcatgttcatcta

SEQ ID NO: 58555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcttcctggtcatgttcat

SEQ ID NO: 58556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgctcttcctggtcatgtt

SEQ ID NO: 58557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatcggcctcctgctcttc

SEQ ID NO: 58558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatcggcctcctgctctt

SEQ ID NO: 58559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaacatcggcctcctgct

SEQ ID NO: 58560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgttgtttaacatcggcctc

SEQ ID NO: 58561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcgttgtttaacatcggc

SEQ ID NO: 58562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgcgttgtttaacatcgg

SEQ ID NO: 58563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgatgtcccttcctgcgtt

SEQ ID NO: 58564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgatgtcccttcctgcgt

SEQ ID NO: 58565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatgatgtcccttcctgcg

SEQ ID NO: 58566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgatgatgtcccttcct

SEQ ID NO: 58567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctttgatgatgtcccttcc

SEQ ID NO: 58568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctttgatgatgtcccttc

SEQ ID NO: 58569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgctttgatgatgtccct

SEQ ID NO: 58570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctttgctttgatgatgtc

SEQ ID NO: 58571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcaaaggagcaaaggggat

SEQ ID NO: 58572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgtctagtcaaaggagcaaa

SEQ ID NO: 58573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccgaatcctacgtctagtc

SEQ ID NO: 58574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaggattggccgaatccta

SEQ ID NO: 58575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaggattggccgaatcct

SEQ ID NO: 58576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgagtgatccgtcttgccag

SEQ ID NO: 58577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttccgagtgatccgtcttgc

SEQ ID NO: 58578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccctgttccgagtgatccgt

SEQ ID NO: 58579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcccctaccctgttccga

SEQ ID NO: 58580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcccctaccctgttccg

SEQ ID NO: 58581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtcccctaccctgttcc

SEQ ID NO: 58582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacgtattttgtgtcccct

SEQ ID NO: 58583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgaaacgtattttgtgtc

SEQ ID NO: 58584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattgaaacgtattttgtgt

SEQ ID NO: 58585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttgattgaaacgtatttt

SEQ ID NO: 58586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctgatttgattgaaacgta

SEQ ID NO: 58587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctgatttgattgaaacg

SEQ ID NO: 58588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagctgatttgattgaaac

SEQ ID NO: 58589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatacaggtatgtttcta

SEQ ID NO: 58590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccacatacaggtatgttt

SEQ ID NO: 58591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctccacatacaggtatgtt

SEQ ID NO: 58592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctccacatacaggtatgt

SEQ ID NO: 58593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcctccacatacaggta

SEQ ID NO: 58594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttattttcctccacatacag

SEQ ID NO: 58595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattattttcctccacatac

SEQ ID NO: 58596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattattttcctccacata

SEQ ID NO: 58597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctattattttcctccac

SEQ ID NO: 58598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctattattttcctcca

SEQ ID NO: 58599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttctattattttcctcc

SEQ ID NO: 58600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatattttatttctattatt

SEQ ID NO: 58601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatattttatttctattat

SEQ ID NO: 58602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatattttatttctatta

SEQ ID NO: 58603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtagcatacatctttaaa

SEQ ID NO: 58604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggtagcatacatctttaa

SEQ ID NO: 58605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtcatcatttcaggtagc

SEQ ID NO: 58606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtcatcatttcaggtag

SEQ ID NO: 58607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttagagtcatcatttcagg

SEQ ID NO: 58608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagataaaactgtttagag

SEQ ID NO: 58609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataagaaatgagttgacaga

SEQ ID NO: 58610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcataagaaatgagttg

SEQ ID NO: 58611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattcataagaaatgagtt

SEQ ID NO: 58612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttgaattcataagaaatg

SEQ ID NO: 58613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaaaaaaaaaaaaaaa

SEQ ID NO: 58614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgtctcaaaaaaaaaaaaaa

SEQ ID NO: 58615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcgacagagcgagactccg

SEQ ID NO: 58616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgggcgacagagcga

SEQ ID NO: 58617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctgggcgacag

SEQ ID NO: 58618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagccgagatcgcgcc

SEQ ID NO: 58619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagtgagccgagatcgcgc

SEQ ID NO: 58620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaatggcgtgaa

SEQ ID NO: 58621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggaggctgaggcaggagaa

SEQ ID NO: 58622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcgggaggctgaggcagga

SEQ ID NO: 58623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcccagctactcgggag

SEQ ID NO: 58624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgggcgtggtagcgggcg

SEQ ID NO: 58625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaaattagccg

SEQ ID NO: 58626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaaattag

SEQ ID NO: 58627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaatacaaaaaatt

SEQ ID NO: 58628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaaggtgaaaccccgtctc

SEQ ID NO: 58629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaacaaggtgaaaccccg

SEQ ID NO: 58630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccgaggcgggcggat

SEQ ID NO: 58631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccgaggcgggcgga

SEQ ID NO: 58632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccgaggcgggcgg

SEQ ID NO: 58633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagcactttgggag

SEQ ID NO: 58634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgcctgtaatcccagcact

SEQ ID NO: 58635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccgggcacggtggctcacg

SEQ ID NO: 58636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggccgggcacggtggctcac

SEQ ID NO: 58637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttggccgggcacggtggc

SEQ ID NO: 58638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtataaaataactgtcttg

SEQ ID NO: 58639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattcagtataaaataactg

SEQ ID NO: 58640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaattgcattcagtataa

SEQ ID NO: 58641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtaattgcattcagtata

SEQ ID NO: 58642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtaattgcattcagtat

SEQ ID NO: 58643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtaattgcattcagta

SEQ ID NO: 58644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaagtaattgcattcagt

SEQ ID NO: 58645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaagtaattgcattcag

SEQ ID NO: 58646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccttttttaagtaattgc

SEQ ID NO: 58647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatccttttttaagtaattg

SEQ ID NO: 58648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatccttttttaagtaat

SEQ ID NO: 58649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaatccttttttaagtaa

SEQ ID NO: 58650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatttcttaatcctttttt

SEQ ID NO: 58651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatttcttaatccttttt

SEQ ID NO: 58652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaatttcttaatcctttt

SEQ ID NO: 58653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttggaatttcttaatcctt

SEQ ID NO: 58654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttggaatttcttaatcc

SEQ ID NO: 58655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttggaatttcttaatc

SEQ ID NO: 58656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatttctctttggaattt

SEQ ID NO: 58657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaaaggagaaaatgtca

SEQ ID NO: 58658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtaaaaaggagaaaatgtc

SEQ ID NO: 58659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggagggaaaaaatggccca

SEQ ID NO: 58660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatggagggaaaaaatggc

SEQ ID NO: 58661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtaaaacactattatg

SEQ ID NO: 58662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatgtaaaacactattat

SEQ ID NO: 58663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaaatgtaaaacactatt

SEQ ID NO: 58664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgagtaggtatcattctt

SEQ ID NO: 58665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtgagtaggtatcattc

SEQ ID NO: 58666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgtgagtaggtatcatt

SEQ ID NO: 58667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatgtgagtaggtatcat

SEQ ID NO: 58668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttctatgtgagtaggt

SEQ ID NO: 58669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattttctatgtgagtagg

SEQ ID NO: 58670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgaattttctatgtgagt

SEQ ID NO: 58671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acggtattgcttgaattttc

SEQ ID NO: 58672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacggtattgcttgaatttt

SEQ ID NO: 58673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatttaacggtattgcttg

SEQ ID NO: 58674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatttaacggtattgctt

SEQ ID NO: 58675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcatttaacggtattgct

SEQ ID NO: 58676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagcatttaacggtattgc

SEQ ID NO: 58677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagcatttaacggtattg

SEQ ID NO: 58678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttagcatttaacggtat

SEQ ID NO: 58679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttagcatttaacggta

SEQ ID NO: 58680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttagcatttaacggt

SEQ ID NO: 58681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttctttttagcattta

SEQ ID NO: 58682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttctttttagcattt

SEQ ID NO: 58683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtgatttatattttcttt

SEQ ID NO: 58684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggtgatttatattttctt

SEQ ID NO: 58685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatttcaggtgatttatat

SEQ ID NO: 58686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgacatttcaggtgattta

SEQ ID NO: 58687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttgacatttcaggtgat

SEQ ID NO: 58688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatagttattgttgacat

SEQ ID NO: 58689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaatattgataatagt

SEQ ID NO: 58690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtgatactcaaaaaaata

SEQ ID NO: 58691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacagaaaaatgtctgaagt

SEQ ID NO: 58692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcacagaaaaatgtctgaag

SEQ ID NO: 58693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtgtacatgtgcttgca

SEQ ID NO: 58694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgtgtacatgtgcttgc

SEQ ID NO: 58695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtgtgtgtacatgtgct

SEQ ID NO: 58696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtgtgtgtacatgtgc

SEQ ID NO: 58697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataacatgaatacatttgt

SEQ ID NO: 58698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atataacatgaatacatttg

SEQ ID NO: 58699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaaaagcttatataaca

SEQ ID NO: 58700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaataaataaataggtta

SEQ ID NO: 58701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaaataaataaataggtt

SEQ ID NO: 58702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttgaaaaataaataaata

SEQ ID NO: 58703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcttgaaaaataaataaa

SEQ ID NO: 58704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcgacagagcaagactctgt

SEQ ID NO: 58705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcgacagagcaagactctg

SEQ ID NO: 58706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggcgacagagcaagactct

SEQ ID NO: 58707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctttggcgacagagcaa

SEQ ID NO: 58708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtaggccaagatcacacc

SEQ ID NO: 58709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcccgggatgcagagattg

SEQ ID NO: 58710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcccgggatgcagagatt

SEQ ID NO: 58711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaatcatttgatcccggg

SEQ ID NO: 58712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggctggagaatcatttgat

SEQ ID NO: 58713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggctgaggctggagaatc

SEQ ID NO: 58714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggaggctgaggctggagaa

SEQ ID NO: 58715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctggaggctgaggctgga

SEQ ID NO: 58716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcccagctactctggag

SEQ ID NO: 58717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accaggtgtggtggcgcatg

SEQ ID NO: 58718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaaaaacacaaaaattaac

SEQ ID NO: 58719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacaaggtgaaaaccgt

SEQ ID NO: 58720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaccagcctggccaacaag

SEQ ID NO: 58721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaccagcctggccaacaa

SEQ ID NO: 58722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtcagaagtttgagacca

SEQ ID NO: 58723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagtcagaagtttgagacc

SEQ ID NO: 58724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccgaggtgggcgaaa

SEQ ID NO: 58725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatcccagcacattgggag

SEQ ID NO: 58726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgcctataatcccagcaca

SEQ ID NO: 58727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggctcacgcctataatccc

SEQ ID NO: 58728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcactgtggctcacgccta

SEQ ID NO: 58729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggctgggcactgtggctc

SEQ ID NO: 58730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgacatataaagtaaata

SEQ ID NO: 58731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctccatgacatataaagta

SEQ ID NO: 58732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaactatctccatgacat

SEQ ID NO: 58733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaactatctccatgaca

SEQ ID NO: 58734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaaactatctccatgac

SEQ ID NO: 58735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgaaactatctccatga

SEQ ID NO: 58736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatttttatgaaactatct

SEQ ID NO: 58737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttgtcatttttatgaaact

SEQ ID NO: 58738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgttgtcatttttatgaaac

SEQ ID NO: 58739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcgttgtcatttttatga

SEQ ID NO: 58740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taataaattatttcgttgtc

SEQ ID NO: 58741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccactataataaattatt

SEQ ID NO: 58742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagaacattataccactat

SEQ ID NO: 58743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagagaacattataccacta

SEQ ID NO: 58744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagagaacattataccact

SEQ ID NO: 58745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgagagaacattatacc

SEQ ID NO: 58746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttattttgagagaacat

SEQ ID NO: 58747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggttattttgagagaaca

SEQ ID NO: 58748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttgtggttattttgaga

SEQ ID NO: 58749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatttgtggttattttgag

SEQ ID NO: 58750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcttcaatttgtggttatt

SEQ ID NO: 58751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaacaaaaatggaaacag

SEQ ID NO: 58752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtaacaaaaatggaaaca

SEQ ID NO: 58753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcagtaacaaaaatgga

SEQ ID NO: 58754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatattcatttcagtaacaa

SEQ ID NO: 58755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatattcatttcagtaaca

SEQ ID NO: 58756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttagatattcatttcagta

SEQ ID NO: 58757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagaacatagctatttaga

SEQ ID NO: 58758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcaattaggagaacatag

SEQ ID NO: 58759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagtactcatgcaattag

SEQ ID NO: 58760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaaagtactcatgcaat

SEQ ID NO: 58761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatattattaaaaagtact

SEQ ID NO: 58762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaacatattattaaaaagt

SEQ ID NO: 58763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattaacatattattaaaaa

SEQ ID NO: 58764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acccaagttctattaacata

SEQ ID NO: 58765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgacccaagttctattaac

SEQ ID NO: 58766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatatagtatatatagtatg

SEQ ID NO: 58767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatactgtatatagtatata

SEQ ID NO: 58768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatatgtatatgtatatgt

SEQ ID NO: 58769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtatatgtatatgtatatg

SEQ ID NO: 58770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatatacgtatacttagtat

SEQ ID NO: 58771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtactgtatatacgtatac

SEQ ID NO: 58772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatagtatacatatactatg

SEQ ID NO: 58773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatacatactatatagta

SEQ ID NO: 58774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgctatatatacatacta

SEQ ID NO: 58775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatagagtatacgcatacta

SEQ ID NO: 58776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgctatatagagtatacg

SEQ ID NO: 58777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatagcgtatatgcatacta

SEQ ID NO: 58778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgctatatagcgtatatg

SEQ ID NO: 58779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatagtatatgcatacta

SEQ ID NO: 58780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatagtatatgca

SEQ ID NO: 58781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatagtatatg

SEQ ID NO: 58782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatagtatacgcatac

SEQ ID NO: 58801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactatatatatagtatacg

SEQ ID NO: 58802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatactatatatatagtata

SEQ ID NO: 58803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatacatactctatac

SEQ ID NO: 58804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtatatagtatagagtatg

SEQ ID NO: 58805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtatatatatacacata

SEQ ID NO: 58806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatattgtgtgtatatatat

SEQ ID NO: 58807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctatatattgtgtgtata

SEQ ID NO: 58808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagataggttcagctatata

SEQ ID NO: 58809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggagataggttcagctata

SEQ ID NO: 58810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggagataggttcagctat

SEQ ID NO: 58811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctggagataggttcagcta

SEQ ID NO: 58812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacaggctttctggagata

SEQ ID NO: 58813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagtacaggctttctgga

SEQ ID NO: 58814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatgttaattagtacagg

SEQ ID NO: 58815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccattagaaatgttaattag

SEQ ID NO: 58816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatatactgccattagaaa

SEQ ID NO: 58817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtgtaaagtatgagcac

SEQ ID NO: 58818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaatgtgtaaagtatgag

SEQ ID NO: 58819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatactgttgaatgtgtaaa

SEQ ID NO: 58820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagaagaatggtagcact

SEQ ID NO: 58821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaaaaactataaagaaga

SEQ ID NO: 58822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaaaaaactataaagaag

SEQ ID NO: 58823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaaaaaactataaagaa

SEQ ID NO: 58824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtaaaaaactataaaga

SEQ ID NO: 58825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggtaaaaaactataaag

SEQ ID NO: 58826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgtcatgaaaatttttt

SEQ ID NO: 58827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgtcatgaaaattttt

SEQ ID NO: 58828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaatgtcatgaaaatttt

SEQ ID NO: 58829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatagtagatgttttcaaa

SEQ ID NO: 58830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaaaaatgcaaataaatt

SEQ ID NO: 58831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaaaaaatgcaaataaat

SEQ ID NO: 58832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacaaaaaatgcaaataaa

SEQ ID NO: 58833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcacaaaaaatgcaaat

SEQ ID NO: 58834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggattattttcacaaaaaa

SEQ ID NO: 58835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacaaccaataaggatac

SEQ ID NO: 58836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agccaaaaacagaagttaaa

SEQ ID NO: 58837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataagaatatagtaaaaatc

SEQ ID NO: 58838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaattaataagaatatagt

SEQ ID NO: 58839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaattaataagaatatag

SEQ ID NO: 58840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataaattaataagaatat

SEQ ID NO: 58841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttataaattaataagaa

SEQ ID NO: 58842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagaaaattgttcttata

SEQ ID NO: 58843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatagaaaattgttcttat

SEQ ID NO: 58844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatagaaaattgttctta

SEQ ID NO: 58845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggccgagaaaggatcaata

SEQ ID NO: 58846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataacagttaaggccgaga

SEQ ID NO: 58847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acataacagttaaggccgag

SEQ ID NO: 58848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagacaaaaaataggtgaa

SEQ ID NO: 58849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggaaaaaatcatcataaat

SEQ ID NO: 58850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggaaaaaatcatcataaa

SEQ ID NO: 58851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggggaaaaaatcatcataa

SEQ ID NO: 58852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggggaaaaaatcatcat

SEQ ID NO: 58853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacaaaaaaacaaaatattc

SEQ ID NO: 58854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaagccaaaaaaaaaaatg

SEQ ID NO: 58855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaagccaaaaaaaaaaat

SEQ ID NO: 58856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcaaaacacaaatttgtaa

SEQ ID NO: 58857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgcaaaacacaaatttgt

SEQ ID NO: 58858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgcaaaacacaaatttg

SEQ ID NO: 58859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctatgcaaaacacaaattt

SEQ ID NO: 58860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtcctttctatgcaaaac

SEQ ID NO: 58861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagtcctttctatgcaaaa

SEQ ID NO: 58862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatagtcctttctatgcaa

SEQ ID NO: 58863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaggaaatatgtggaaata

SEQ ID NO: 58864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtaggaaatatgtggaaa

SEQ ID NO: 58865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaagattctagtagg

SEQ ID NO: 58866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagttaaaaaaaaagattct

SEQ ID NO: 58867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgaaaagatcacatgaat

SEQ ID NO: 58868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtgtgaaaagatcacatg

SEQ ID NO: 58869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtgtgaaaagatcacat

SEQ ID NO: 58870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatttactgtgtgaaaag

SEQ ID NO: 58871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtataattaccaatttac

SEQ ID NO: 58872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtataattaccaattta

SEQ ID NO: 58873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatgtataattaccaattt

SEQ ID NO: 58874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactttaatgtataattacc

SEQ ID NO: 58875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagagtccaaattaaact

SEQ ID NO: 58876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagagagtccaaattaaac

SEQ ID NO: 58877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtgggtttgaagagagtcc

SEQ ID NO: 58878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatataaaagctcagtggg

SEQ ID NO: 58879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcaaatataaaagctcagt

SEQ ID NO: 58880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaaactgttcaaatata

SEQ ID NO: 58881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacatatagatgttaaata

SEQ ID NO: 58882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaatattaagacatatag

SEQ ID NO: 58883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaaatattaagacatat

SEQ ID NO: 58884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgcaaaatattaagaca

SEQ ID NO: 58885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attctgcaaaatattaagac

SEQ ID NO: 58886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtgacaagaggtggctta

SEQ ID NO: 58887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagaaaattagggtgacaa

SEQ ID NO: 58888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctggaagaaaattagggt

SEQ ID NO: 58889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattcatctggaagaaaatt

SEQ ID NO: 58890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaattcatctggaagaaaa

SEQ ID NO: 58891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgattctaaattcatctg

SEQ ID NO: 58892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtagtgtgggtaataaata

SEQ ID NO: 58893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtagtgtgggtaataaat

SEQ ID NO: 58894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtagtgtgggtaataaa

SEQ ID NO: 58895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtagtgtgggtaataa

SEQ ID NO: 58896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatgtagtgtgggtaata

SEQ ID NO: 58897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggaaaatatcaatgagtc

SEQ ID NO: 58898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaattcaaggaaaatatca

SEQ ID NO: 58899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctataaattcaaggaaaa

SEQ ID NO: 58900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatctataaattcaagga

SEQ ID NO: 58901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaatctataaattcaagg

SEQ ID NO: 58902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttattaatctataaat

SEQ ID NO: 58903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatttattaatctataaa

SEQ ID NO: 58904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaatttattaatctataa

SEQ ID NO: 58905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agactttcaaatttattaat

SEQ ID NO: 58906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattaagactttcaaattt

SEQ ID NO: 58907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgtaattaagactttcaa

SEQ ID NO: 58908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcattgtaattaagactttc

SEQ ID NO: 58909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcattgtaattaagactt

SEQ ID NO: 58910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctcattgtaattaagact

SEQ ID NO: 58911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataagcttctctcattgta

SEQ ID NO: 58912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agataagcttctctcattgt

SEQ ID NO: 58913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgtacttagataagctt

SEQ ID NO: 58914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaggattgtcatgtactta

SEQ ID NO: 58915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataattgaaaggattgtc

SEQ ID NO: 58916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatataaaagaaagctaaa

SEQ ID NO: 58917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggatataaaagaaagctaa

SEQ ID NO: 58918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggatataaaagaaagcta

SEQ ID NO: 58919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaaaactttaggatataa

SEQ ID NO: 58920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaagaaaactttaggatat

SEQ ID NO: 58921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaagaaaactttaggata

SEQ ID NO: 58922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatatgagacttctgaaga

SEQ ID NO: 58923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatatgagacttctgaag

SEQ ID NO: 58924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcatatgagacttctgaa

SEQ ID NO: 58925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataataactttatcatatga

SEQ ID NO: 58926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaataataactttatcat

SEQ ID NO: 58927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caataaaaataaagtaaatt

SEQ ID NO: 58928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaattgcaataaaaataaa

SEQ ID NO: 58929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcacaattgcaataaaaa

SEQ ID NO: 58930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatctgattcacaattg

SEQ ID NO: 58931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatgaaaaaaattagaaa

SEQ ID NO: 58932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacatgaaaaaaattagaa

SEQ ID NO: 58933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttatacatgaaaaaaatt

SEQ ID NO: 58934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataattatcttatacatgaa

SEQ ID NO: 58935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgtgccaacactaataat

SEQ ID NO: 58936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattacatgtgccaacacta

SEQ ID NO: 58937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattacatgtgccaacact

SEQ ID NO: 58938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattacatgtgccaacac

SEQ ID NO: 58939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaggtacaaattttaaat

SEQ ID NO: 58940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagttcaaaaggtacaaatt

SEQ ID NO: 58941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattagagttcaaaaggtac

SEQ ID NO: 58942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaataaattcaattagagt

SEQ ID NO: 58943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagagaatcaactaaaaat

SEQ ID NO: 58944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatattgaaagagaatcaa

SEQ ID NO: 58945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatatattgaaagagaat

SEQ ID NO: 58946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcatatattgaaagagaa

SEQ ID NO: 58947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atataatgaaagaacttgtt

SEQ ID NO: 58948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catataatgaaagaacttgt

SEQ ID NO: 58949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatataatgaaagaactt

SEQ ID NO: 58950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcatataatgaaagaact

SEQ ID NO: 58951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atataatgaccttcttcata

SEQ ID NO: 58952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatataatgaccttcttcat

SEQ ID NO: 58953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataagaaaacagagaggta

SEQ ID NO: 58954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaatgcaattagataaga

SEQ ID NO: 58955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggccaatgcaattagata

SEQ ID NO: 58956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttgttggccaatgcaat

SEQ ID NO: 58957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgttgttggccaatgcaa

SEQ ID NO: 58958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgttgttggccaatgca

SEQ ID NO: 58959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtgttgttggccaatgc

SEQ ID NO: 58960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttagtgttgttggccaa

SEQ ID NO: 58961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcatccctgtttttagtg

SEQ ID NO: 58962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcaggaaaaaaaaaagag

SEQ ID NO: 58963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaagtcaggaaaaaaaaaa

SEQ ID NO: 58964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattaagtcaggaaaaaaa

SEQ ID NO: 58965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagcattcctattaagtca

SEQ ID NO: 58966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaagcattcctattaagt

SEQ ID NO: 58967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaaaaatgattctgaaagc

SEQ ID NO: 58968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acactaacaaaaatgattct

SEQ ID NO: 58969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacactaacaaaaatgattc

SEQ ID NO: 58970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgagaatttcacactaac

SEQ ID NO: 58971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtgagaatttcacactaa

SEQ ID NO: 58972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttaggtgagaatttca

SEQ ID NO: 58973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atataagaaaatgtattaaa

SEQ ID NO: 58974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaccagaagtcataccaaa

SEQ ID NO: 58975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaagcatattatcaccag

SEQ ID NO: 58976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaagcatattatcacca

SEQ ID NO: 58977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaaagcatattatcacc

SEQ ID NO: 58978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatcaataattttggaaaa

SEQ ID NO: 58979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatcaataattttggaaa

SEQ ID NO: 58980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgccacataacagagtaa

SEQ ID NO: 58981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatcataaaattgagtgcc

SEQ ID NO: 58982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaatcataaaattgagtgc

SEQ ID NO: 58983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgacttagaatcataaaa

SEQ ID NO: 58984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggttgcatgacttagaat

SEQ ID NO: 58985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaggttcaaggttgcatg

SEQ ID NO: 58986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaatctgaaaaggttcaag

SEQ ID NO: 58987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaacaggttatcaatctg

SEQ ID NO: 58988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcaacaggttatcaatct

SEQ ID NO: 58989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagtttaatcaacaggtta

SEQ ID NO: 58990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctacaagtttaatcaacagg

SEQ ID NO: 58991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagattactacaagttta

SEQ ID NO: 58992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagagagagattatagaga

SEQ ID NO: 58993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagagagagattatagag

SEQ ID NO: 58994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagagagagagattataga

SEQ ID NO: 58995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaagagagagagattatag

SEQ ID NO: 58996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacttttaagagagagag

SEQ ID NO: 58997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattataaacttttaagag

SEQ ID NO: 58998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaattataaacttttaaga

SEQ ID NO: 58999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaattataaacttttaag

SEQ ID NO: 59000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagaattataaacttttaa

SEQ ID NO: 59001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagaattataaactttta

SEQ ID NO: 59002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttagaattataaacttt

SEQ ID NO: 59003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttagaattataaactt

SEQ ID NO: 59004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttctttttagaattata

SEQ ID NO: 59005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattgtatttctttttaga

SEQ ID NO: 59006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggattgtatttctttttag

SEQ ID NO: 59007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggattgtatttcttttta

SEQ ID NO: 59008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaagtattttaggattgta

SEQ ID NO: 59009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaaagtattttaggattgt

SEQ ID NO: 59010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatatcttgcaaagtattt

SEQ ID NO: 59011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacatatcttgcaaagtatt

SEQ ID NO: 59012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacatatcttgcaaagtat

SEQ ID NO: 59013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcacatatcttgcaaag

SEQ ID NO: 59014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattttcacatatcttgca

SEQ ID NO: 59015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttattttcacatatctt

SEQ ID NO: 59016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttgttattttcacatat

SEQ ID NO: 59017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttgttgttattttcaca

SEQ ID NO: 59018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgttgttgttattttcac

SEQ ID NO: 59019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgttgttgttattttca

SEQ ID NO: 59020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgttgttgttattttc

SEQ ID NO: 59021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgttgttgttgttatt

SEQ ID NO: 59022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttgttgttgttgttat

SEQ ID NO: 59023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtttttgttgttgttgtt

SEQ ID NO: 59024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgtttttgttgttgttgt

SEQ ID NO: 59025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttcttgtttttgttgttg

SEQ ID NO: 59026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcttcttgtttttgttgt

SEQ ID NO: 59027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatcttcttgtttttgttg

SEQ ID NO: 59028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatcttcttgtttttgtt

SEQ ID NO: 59029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatcttcttgtttttgt

SEQ ID NO: 59030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttctatcttcttgtttt

SEQ ID NO: 59031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatggttgtttttctatct

SEQ ID NO: 59032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgccatggttgtttttct

SEQ ID NO: 59033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacattcattgccatggttg

SEQ ID NO: 59034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatacattcattgccatgg

SEQ ID NO: 59035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctatacattcattgccatg

SEQ ID NO: 59036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttcctatacattcattg

SEQ ID NO: 59037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacttcctatacattcatt

SEQ ID NO: 59038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatacttcctatacattcat

SEQ ID NO: 59039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaataacagcacatgattt

SEQ ID NO: 59040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtctgtgaataacagcac

SEQ ID NO: 59041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaccagccatggtgttcatg

SEQ ID NO: 59042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaaccagccatggtgttc

SEQ ID NO: 59043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaagtgtataaaatgccaa

SEQ ID NO: 59044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacaagtgtataaaatgcca

SEQ ID NO: 59045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacttcacaagtgtataaa

SEQ ID NO: 59046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatacttcacaagtgtataa

SEQ ID NO: 59047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcttaatacttcacaagt

SEQ ID NO: 59048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcttaatacttcacaag

SEQ ID NO: 59049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagcttaatacttcacaa

SEQ ID NO: 59050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacagcttaatacttcaca

SEQ ID NO: 59051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacagcttaatacttcac

SEQ ID NO: 59052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttacagcttaatactt

SEQ ID NO: 59053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttacagcttaatact

SEQ ID NO: 59054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttacagcttaatac

SEQ ID NO: 59055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatgccagttttattttt

SEQ ID NO: 59056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagaaatgccagttttattt

SEQ ID NO: 59057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatctctagaaatgccagt

SEQ ID NO: 59058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgaagttaagatctcta

SEQ ID NO: 59059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtgaagttaagatctct

SEQ ID NO: 59060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaatttaaagtgaagtta

SEQ ID NO: 59061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagaatttaaagtgaagtt

SEQ ID NO: 59062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccagaatttaaagtgaag

SEQ ID NO: 59063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaaattcttccagaattt

SEQ ID NO: 59064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaaaattcttccagaatt

SEQ ID NO: 59065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaatttgtgaaaattcttc

SEQ ID NO: 59066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagccagaatatctgtgaa

SEQ ID NO: 59067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgataatattaatagccag

SEQ ID NO: 59068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaatgataatattaatag

SEQ ID NO: 59069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattaatgataatattaata

SEQ ID NO: 59070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatttgattaatgataata

SEQ ID NO: 59071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcatttgattaatgataat

SEQ ID NO: 59072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacatgtgagacttgtcat

SEQ ID NO: 59073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcacatgtgagacttgtca

SEQ ID NO: 59074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcacatgtgagacttgtc

SEQ ID NO: 59075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttagcacatgtgagact

SEQ ID NO: 59076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggttttagcacatgtgaga

SEQ ID NO: 59077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggttttagcacatgtgag

SEQ ID NO: 59078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaataacttctggttttagc

SEQ ID NO: 59079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctgaaataacttctggt

SEQ ID NO: 59080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaaccaatgttgaatctg

SEQ ID NO: 59081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaaaccaatgttgaatct

SEQ ID NO: 59082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcttggaaaaccaatgtt

SEQ ID NO: 59083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatagctgtgtcttggaa

SEQ ID NO: 59084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatagctgtgtcttgga

SEQ ID NO: 59085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatgtttatatatagctgt

SEQ ID NO: 59086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaccatgtttatatatag

SEQ ID NO: 59087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaactagttaccatgttt

SEQ ID NO: 59088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaactagttaccatgtt

SEQ ID NO: 59089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcaaaactagttaccatgt

SEQ ID NO: 59090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttgcaaaactagttacc

SEQ ID NO: 59091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatattacctttgcaaaac

SEQ ID NO: 59092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatattacctttgcaaaa

SEQ ID NO: 59093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttccaatattacctttgc

SEQ ID NO: 59094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttccaatattacctttg

SEQ ID NO: 59095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatttagtttccaatatta

SEQ ID NO: 59096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgatatttagtttccaata

SEQ ID NO: 59097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgatatttagtttccaat

SEQ ID NO: 59098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttgttgatatttagttt

SEQ ID NO: 59099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaggaaattatacttgttg

SEQ ID NO: 59100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagaaggaaattatacttg

SEQ ID NO: 59101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctattagaaggaaattata

SEQ ID NO: 59102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatctattagaaggaaatta

SEQ ID NO: 59103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatctattagaaggaaatt

SEQ ID NO: 59104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggccccaaagccaaatat

SEQ ID NO: 59105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactacaggccccaaagcca

SEQ ID NO: 59106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactacaggccccaaagcc

SEQ ID NO: 59107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtttacactacaggcccca

SEQ ID NO: 59108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggtttacactacaggccc

SEQ ID NO: 59109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggtttacactacaggcc

SEQ ID NO: 59110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtgtttctgggtttacac

SEQ ID NO: 59111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atactacagtgtttctgggt

SEQ ID NO: 59112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatactacagtgtttctgg

SEQ ID NO: 59113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctcatactacagtgttt

SEQ ID NO: 59114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaagcaaaacaaatatctg

SEQ ID NO: 59115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaagtcagtacaatgaaa

SEQ ID NO: 59116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtaagtcagtacaatgaa

SEQ ID NO: 59117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgagtaagtcagtacaatg

SEQ ID NO: 59118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttgagtaagtcagtaca

SEQ ID NO: 59119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcttgagtaagtcagtac

SEQ ID NO: 59120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacacaaatttactcttgag

SEQ ID NO: 59121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacacaaatttactcttga

SEQ ID NO: 59122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaacacaaatttactctt

SEQ ID NO: 59123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattcttgaacacaaattta

SEQ ID NO: 59124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggaagtatatgctgaatt

SEQ ID NO: 59125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctcaaggaagtatatgct

SEQ ID NO: 59126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgctcaaggaagtatatgc

SEQ ID NO: 59127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttatgctcaaggaagtat

SEQ ID NO: 59128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacttatgctcaaggaagta

SEQ ID NO: 59129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacttcacttatgctcaagg

SEQ ID NO: 59130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaaagctaaacttcactt

SEQ ID NO: 59131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtaaagctaaacttcact

SEQ ID NO: 59132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagtaaagctaaacttcac

SEQ ID NO: 59133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagtaaagctaaacttca

SEQ ID NO: 59134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagtaaagctaaacttc

SEQ ID NO: 59135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttgagtaaagctaaac

SEQ ID NO: 59136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttgagtaaagctaaa

SEQ ID NO: 59137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttgagtaaagctaa

SEQ ID NO: 59138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattttattttttgagtaa

SEQ ID NO: 59139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagattttattttttgagta

SEQ ID NO: 59140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagattttattttttgagt

SEQ ID NO: 59141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagattttattttttgag

SEQ ID NO: 59142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcagattttatttttt

SEQ ID NO: 59143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttcagattttattttt

SEQ ID NO: 59144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggtaagaatatttatttt

SEQ ID NO: 59145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattgtaggtaagaatattt

SEQ ID NO: 59146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctccattgtaggtaagaat

SEQ ID NO: 59147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgattatctccattgtaggt

SEQ ID NO: 59148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttgtgattatctccatt

SEQ ID NO: 59149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggttgtgattatctccat

SEQ ID NO: 59150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggttgtgattatctcca

SEQ ID NO: 59151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttgtggttgtgattatc

SEQ ID NO: 59152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattttgtggttgtgattat

SEQ ID NO: 59153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgattttgtggttgtgatta

SEQ ID NO: 59154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgattttgtggttgtgatt

SEQ ID NO: 59155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggatggaatatttttgat

SEQ ID NO: 59156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgtaggatggaatatttt

SEQ ID NO: 59157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactgtaggatggaatattt

SEQ ID NO: 59158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttcactgtaggatggaata

SEQ ID NO: 59159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctacttcactgtaggatgga

SEQ ID NO: 59160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agacactactacttcactgt

SEQ ID NO: 59161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcagacactactacttca

SEQ ID NO: 59162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctccctcagacactacta

SEQ ID NO: 59163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaactgatctccctcagaca

SEQ ID NO: 59164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaatgtgtgctaaaactg

SEQ ID NO: 59165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actggagaatgtgtgctaaa

SEQ ID NO: 59166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactggagaatgtgtgctaa

SEQ ID NO: 59167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactggagaatgtgtgcta

SEQ ID NO: 59168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcactggagaatgtgtgct

SEQ ID NO: 59169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatccttttcactggagaa

SEQ ID NO: 59170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatccttttcactggaga

SEQ ID NO: 59171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatccttttcactggag

SEQ ID NO: 59172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataatccttttcactgga

SEQ ID NO: 59173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gataaatgtggtttttataa

SEQ ID NO: 59174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattggataaatgtggtttt

SEQ ID NO: 59175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattggataaatgtggttt

SEQ ID NO: 59176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattggataaatgtggtt

SEQ ID NO: 59177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagttttatattggataaat

SEQ ID NO: 59178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacatggtaaccatgatggt

SEQ ID NO: 59179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcaacatggtaaccatga

SEQ ID NO: 59180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgtctcaacatggtaacc

SEQ ID NO: 59181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctgtctcaacatggtaac

SEQ ID NO: 59182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatctgtctcaacatggta

SEQ ID NO: 59183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatcatggttcttatctgt

SEQ ID NO: 59184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atattagtatcatggttctt

SEQ ID NO: 59185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatattagtatcatggttct

SEQ ID NO: 59186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatattagtatcatggttc

SEQ ID NO: 59187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgacaaatcaagcctttga

SEQ ID NO: 59188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctagtgacaaatcaagcc

SEQ ID NO: 59189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctagtgacaaatcaagc

SEQ ID NO: 59190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaacaaaatccaaggatg

SEQ ID NO: 59191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagaacaaaatccaaggat

SEQ ID NO: 59192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcagaacaaaatccaagga

SEQ ID NO: 59193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgcagaacaaaatccaag

SEQ ID NO: 59194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgcagaacaaaatccaa

SEQ ID NO: 59195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctttgcagaacaaaatc

SEQ ID NO: 59196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttctttgcagaacaaaat

SEQ ID NO: 59197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatttctttgcagaacaaa

SEQ ID NO: 59198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttatttctttgcagaac

SEQ ID NO: 59199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatattattcttatttcttt

SEQ ID NO: 59200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattcgatattattcttatt

SEQ ID NO: 59201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcattcgatattattctta

SEQ ID NO: 59202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgcattcgatattattc

SEQ ID NO: 59203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctgcattcgatattatt

SEQ ID NO: 59204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagtttactctgcattcg

SEQ ID NO: 59205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaagtttactctgcattc

SEQ ID NO: 59206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataatacttgaaaagttta

SEQ ID NO: 59207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggataatacttgaaaagtt

SEQ ID NO: 59208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggataatacttgaaaagt

SEQ ID NO: 59209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttctggataatacttgaa

SEQ ID NO: 59210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttctggataatacttga

SEQ ID NO: 59211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatttctggataatacttg

SEQ ID NO: 59212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcacatctttaatttctg

SEQ ID NO: 59213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgcacatctttaatttct

SEQ ID NO: 59214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgcacatctttaatttc

SEQ ID NO: 59215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgcacatctttaattt

SEQ ID NO: 59216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttaatgcacatcttta

SEQ ID NO: 59217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcatttttaatgcacatc

SEQ ID NO: 59218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattcatttttaatgcaca

SEQ ID NO: 59219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaattcatttttaatgcac

SEQ ID NO: 59220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctaattcatttttaatg

SEQ ID NO: 59221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattatttctaattcattt

SEQ ID NO: 59222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaattatttctaattcatt

SEQ ID NO: 59223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaattatttctaattcat

SEQ ID NO: 59224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatatagattttcaaatta

SEQ ID NO: 59225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatatagattttcaaatt

SEQ ID NO: 59226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcatatagattttcaaat

SEQ ID NO: 59227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaccaggggtaaaaaaatat

SEQ ID NO: 59228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcgaccaggggtaaaaaaa

SEQ ID NO: 59229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggtccaagaagccacaaaa

SEQ ID NO: 59230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatgcaatgaaaaagctgg

SEQ ID NO: 59231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacagaagaacagaagaaa

SEQ ID NO: 59232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgacagaagaacagaagaa

SEQ ID NO: 59233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgacagaagaacagaaga

SEQ ID NO: 59234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggtcaagacatctttatg

SEQ ID NO: 59235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaggtcaagacatctttat

SEQ ID NO: 59236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttggaggtcaagacatct

SEQ ID NO: 59237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accttggaggtcaagacatc

SEQ ID NO: 59238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccttggaggtcaagacat

SEQ ID NO: 59239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaccttggaggtcaagac

SEQ ID NO: 59240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaccttggaggtcaaga

SEQ ID NO: 59241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctttaccttggaggtca

SEQ ID NO: 59242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttctttaccttggaggtc

SEQ ID NO: 59243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttctttaccttggag

SEQ ID NO: 59244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttctttaccttgga

SEQ ID NO: 59245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttgtttctttaccttgg

SEQ ID NO: 59246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttgtttctttaccttg

SEQ ID NO: 59247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtttgtttctttacctt

SEQ ID NO: 59248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttgtttgtttctttac

SEQ ID NO: 59249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttgtttgtttcttta

SEQ ID NO: 59250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catttattttttgtttgttt

SEQ ID NO: 59251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actacatttattttttgttt

SEQ ID NO: 59252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactacatttattttttgtt

SEQ ID NO: 59253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactacatttattttttgt

SEQ ID NO: 59254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttaactacatttatttt

SEQ ID NO: 59255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggttttaactacatttatt

SEQ ID NO: 59256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaaagatgtagacaatga

SEQ ID NO: 59257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaatctatagaaagatgta

SEQ ID NO: 59258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaatctatagaaagatgt

SEQ ID NO: 59259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtaatctatagaaagatg

SEQ ID NO: 59260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttagtaatctatagaaag

SEQ ID NO: 59261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctattttagtaatctata

SEQ ID NO: 59262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctattttagtaatctat

SEQ ID NO: 59263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacctattttagtaatcta

SEQ ID NO: 59264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacattttaacctatttta

SEQ ID NO: 59265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattaacacattttaaccta

SEQ ID NO: 59266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattaacacattttaacc

SEQ ID NO: 59267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatattaacacattttaac

SEQ ID NO: 59268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctatattaacacatttt

SEQ ID NO: 59269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctatattaacacattt

SEQ ID NO: 59270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttctatattaacacatt

SEQ ID NO: 59271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatgaacataataaaatac

SEQ ID NO: 59272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatagctatcatgaacat

SEQ ID NO: 59273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatagctatcatgaaca

SEQ ID NO: 59274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtatagctatcatgaac

SEQ ID NO: 59275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatatattttatgtatagc

SEQ ID NO: 59276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagatatattttatgtatag

SEQ ID NO: 59277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaagatatattttatgta

SEQ ID NO: 59278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacatatgtaattatttaag

SEQ ID NO: 59279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacacatatgtaattattta

SEQ ID NO: 59280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacacatatgtaattattt

SEQ ID NO: 59281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagacccatgtttctacaca

SEQ ID NO: 59282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagacccatgtttctacac

SEQ ID NO: 59283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtttggagacccatgtttc

SEQ ID NO: 59284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgtgtttggagacccatg

SEQ ID NO: 59285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactgtgtttggagacccat

SEQ ID NO: 59286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatgcacatttaactgtg

SEQ ID NO: 59287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatgcacatttaactgt

SEQ ID NO: 59288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtaatacaaatatttat

SEQ ID NO: 59289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatgtaatacaaatatt

SEQ ID NO: 59290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatatgtaatacaaatat

SEQ ID NO: 59291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agccaatccttattatatgt

SEQ ID NO: 59292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcacaccaaaagaatattga

SEQ ID NO: 59293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attagcacaccaaaagaata

SEQ ID NO: 59294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaacactgattagcaca

SEQ ID NO: 59295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacaacactgattagcac

SEQ ID NO: 59296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcagataaaaaagataaaag

SEQ ID NO: 59297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaataaaagtcacagtaag

SEQ ID NO: 59298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcaataaaagtcacagtaa

SEQ ID NO: 59299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagcaataaaagtcacagt

SEQ ID NO: 59300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagcaataaaagtcacag

SEQ ID NO: 59301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttagcaataaaagtcaca

SEQ ID NO: 59302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaattttcttagcaataaa

SEQ ID NO: 59303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaattttcttagcaataa

SEQ ID NO: 59304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacaaattttcttagcaat

SEQ ID NO: 59305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcttacaaattttcttag

SEQ ID NO: 59306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattcttacaaattttctta

SEQ ID NO: 59307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattcttacaaattttctt

SEQ ID NO: 59308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaattcttacaaattttct

SEQ ID NO: 59309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttaattcttacaaattt

SEQ ID NO: 59310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attacttttaattcttacaa

SEQ ID NO: 59311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaaatcatcaaagaagata

SEQ ID NO: 59312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccaaatcatcaaagaagat

SEQ ID NO: 59313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatttgccaaatcatcaa

SEQ ID NO: 59314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaatatttgccaaatcatc

SEQ ID NO: 59315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaagttctaaatatttgc

SEQ ID NO: 59316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaagttctaaatatttg

SEQ ID NO: 59317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaaagttctaaatattt

SEQ ID NO: 59318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttataaaagttctaaatat

SEQ ID NO: 59319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctttataaaagttctaaa

SEQ ID NO: 59320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctattctttataaaagttc

SEQ ID NO: 59321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctccctattctttataaaa

SEQ ID NO: 59322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctccctattctttataaa

SEQ ID NO: 59323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgatttggctccctattct

SEQ ID NO: 59324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcatgatttggctcccta

SEQ ID NO: 59325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatgggagttcactcatg

SEQ ID NO: 59326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtaattgtgaatgggagt

SEQ ID NO: 59327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagtaattgtgaatgggag

SEQ ID NO: 59328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtagtaattgtgaatggga

SEQ ID NO: 59329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtagtaattgtgaatgg

SEQ ID NO: 59330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttgtagtaattgtgaat

SEQ ID NO: 59331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctctttgtagtaattgtg

SEQ ID NO: 59332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctctttgtagtaattgt

SEQ ID NO: 59333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattctctttgtagtaattg

SEQ ID NO: 59334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtattttattctctttgta

SEQ ID NO: 59335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaggtattttattctcttt

SEQ ID NO: 59336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattcctaggtattttattc

SEQ ID NO: 59337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagttggattcctaggtat

SEQ ID NO: 59338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaagttggattcctaggta

SEQ ID NO: 59339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatcccttgtaagttggat

SEQ ID NO: 59340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatcccttgtaagttgga

SEQ ID NO: 59341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaggtccttcacatccct

SEQ ID NO: 59342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaggtccttcacatccc

SEQ ID NO: 59343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgaagaggtccttcacat

SEQ ID NO: 59344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccttgaagaggtccttcac

SEQ ID NO: 59345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttctccttgaagaggtc

SEQ ID NO: 59346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttctccttgaagaggt

SEQ ID NO: 59347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcagtggtttgtagttctc

SEQ ID NO: 59348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctgagcagtggtttgtagt

SEQ ID NO: 59349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgctgagcagtggtttgtag

SEQ ID NO: 59350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcgctgagcagtggtttg

SEQ ID NO: 59351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcgctgagcagtggttt

SEQ ID NO: 59352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcgctgagcagtggtt

SEQ ID NO: 59353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttcgctgagcagtggt

SEQ ID NO: 59354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatttcgctgagcagtg

SEQ ID NO: 59355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcctcttttatttcgctg

SEQ ID NO: 59356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcctcttttatttcgct

SEQ ID NO: 59357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtgtcctcttttatttc

SEQ ID NO: 59358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtgtcctcttttattt

SEQ ID NO: 59359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgtttgtgtcctcttt

SEQ ID NO: 59360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttgtttgtgtcctctt

SEQ ID NO: 59361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccatttgtttgtgtcctc

SEQ ID NO: 59362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccatgagcatggaatattc

SEQ ID NO: 59363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatccatgagcatggaata

SEQ ID NO: 59364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctatccatgagcatggaat

SEQ ID NO: 59365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcttcctatccatgagca

SEQ ID NO: 59366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgatattgagtcttcctat

SEQ ID NO: 59367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgatattgagtcttccta

SEQ ID NO: 59368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgatattgagtcttcct

SEQ ID NO: 59369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcagtaatgccattttcat

SEQ ID NO: 59370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggcagtaatgccattttca

SEQ ID NO: 59371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttgggcagtaatgccatt

SEQ ID NO: 59372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaattaccttgggcagtaa

SEQ ID NO: 59373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaattaccttgggcagta

SEQ ID NO: 59374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttataaattaccttggg

SEQ ID NO: 59375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggggatagcattgaattt

SEQ ID NO: 59376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatggggatagcattgaatt

SEQ ID NO: 59377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaagaaagtcagtggtagc

SEQ ID NO: 59378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaagaaagtcagtggtag

SEQ ID NO: 59379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaagaaagtcagtggta

SEQ ID NO: 59380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caattttgtgaagaaagtca

SEQ ID NO: 59381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaattttgtgaagaaagtc

SEQ ID NO: 59382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaattttgtgaagaaagt

SEQ ID NO: 59383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaattttgtgaagaaag

SEQ ID NO: 59384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccaattttgtgaagaaa

SEQ ID NO: 59385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttccaattttgtgaagaa

SEQ ID NO: 59386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtagtttttttccaattt

SEQ ID NO: 59387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtagtttttttccaatt

SEQ ID NO: 59388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagtagtttttttccaat

SEQ ID NO: 59389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatgaactttaaagtagt

SEQ ID NO: 59390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccatatgaactttaaag

SEQ ID NO: 59391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttccatatgaactttaaa

SEQ ID NO: 59392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttccatatgaactttaa

SEQ ID NO: 59393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggttccatatgaacttta

SEQ ID NO: 59394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggttccatatgaacttt

SEQ ID NO: 59395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttggttccatatgaactt

SEQ ID NO: 59396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttggttccatatgaac

SEQ ID NO: 59397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcaggctcttttttggttc

SEQ ID NO: 59398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctatgcaggctcttttttg

SEQ ID NO: 59399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctatgcaggctctttttt

SEQ ID NO: 59400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttggctatgcaggctctt

SEQ ID NO: 59401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattatcttggctatgcag

SEQ ID NO: 59402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggattatcttggctatgca

SEQ ID NO: 59403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttaggattatcttggctat

SEQ ID NO: 59404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttaggattatcttggcta

SEQ ID NO: 59405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttaggattatcttggct

SEQ ID NO: 59406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcttaggattatcttggc

SEQ ID NO: 59407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgcttaggattatcttgg

SEQ ID NO: 59408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgcttaggattatctt

SEQ ID NO: 59409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttttgcttaggattat

SEQ ID NO: 59410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttttgcttaggatta

SEQ ID NO: 59411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttctttttgcttaggatt

SEQ ID NO: 59412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctttgttctttttgctt

SEQ ID NO: 59413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtcaggtagtgtgacgcc

SEQ ID NO: 59414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagtcaggtagtgtgacgc

SEQ ID NO: 59415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtatagtttgaagtcagg

SEQ ID NO: 59416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagtatagtttgaagtcag

SEQ ID NO: 59417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagccttgtagtatagtttg

SEQ ID NO: 59418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtagccttgtagtatagt

SEQ ID NO: 59419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttactgtagccttgtagta

SEQ ID NO: 59420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttactgtagccttgtagt

SEQ ID NO: 59421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttactgtagccttgtag

SEQ ID NO: 59422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttggttactgtagccttg

SEQ ID NO: 59423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaccagtaccatgctgttt

SEQ ID NO: 59424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaccagtaccatgctgtt

SEQ ID NO: 59425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaccagtaccatgctgt

SEQ ID NO: 59426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttggtaccagtaccatgc

SEQ ID NO: 59427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtatgtatctgttttggt

SEQ ID NO: 59428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggtgtatgtatctgtttt

SEQ ID NO: 59429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttggtgtatgtatctgtt

SEQ ID NO: 59430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgttggtgtatgtatct

SEQ ID NO: 59431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttctgttggtgtatgtat

SEQ ID NO: 59432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgttctgttggtgtatg

SEQ ID NO: 59433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttctgttctgttggtgta

SEQ ID NO: 59434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcctctgttctgttctgt

SEQ ID NO: 59435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaggcctctgttctgttct

SEQ ID NO: 59436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaggcctctgttctgttc

SEQ ID NO: 59437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgaggcctctgttctg

SEQ ID NO: 59438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagatgtgtagtgttatttc

SEQ ID NO: 59439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaggatcagatggttgta

SEQ ID NO: 59440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaaggatcagatggttgt

SEQ ID NO: 59441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaggtttgtcaaggatcag

SEQ ID NO: 59442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaggtttgtcaaggatca

SEQ ID NO: 59443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaggtttgtcaaggatc

SEQ ID NO: 59444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgaggtttgtcaaggat

SEQ ID NO: 59445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgtgaggtttgtcaag

SEQ ID NO: 59446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttgtgaggtttgtcaa

SEQ ID NO: 59447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtttttgtgaggtttgt

SEQ ID NO: 59448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccgttgcttgtttttgtga

SEQ ID NO: 59449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccgttgcttgtttttgtg

SEQ ID NO: 59450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccccgttgcttgtttttgt

SEQ ID NO: 59451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagggaagcctttccccg

SEQ ID NO: 59452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaatagggaagcctttcc

SEQ ID NO: 59453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaatagggaagcctttc

SEQ ID NO: 59454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagcatcatttattaaata

SEQ ID NO: 59455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagcatcatttattaaat

SEQ ID NO: 59456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccagcatcatttattaaa

SEQ ID NO: 59457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccagttttcccagcatcat

SEQ ID NO: 59458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catatggctagccagttttc

SEQ ID NO: 59459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatatggctagccagttt

SEQ ID NO: 59460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacatatggctagccagtt

SEQ ID NO: 59461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctacatatggctagccagt

SEQ ID NO: 59462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactttctacatatggctag

SEQ ID NO: 59463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caactttctacatatggcta

SEQ ID NO: 59464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacaaggtgtaaggaaggga

SEQ ID NO: 59465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacaaggtgtaaggaaggg

SEQ ID NO: 59466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacaaggtgtaaggaagg

SEQ ID NO: 59467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtacaaggtgtaaggaag

SEQ ID NO: 59468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttgtacaaggtgtaag

SEQ ID NO: 59469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttaatttttgtacaaggt

SEQ ID NO: 59470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagttaatttttgtacaagg

SEQ ID NO: 59471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccatcttgagttaatttt

SEQ ID NO: 59472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatccatcttgagttaattt

SEQ ID NO: 59473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatccatcttgagttaatt

SEQ ID NO: 59474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtctttaatccatcttgag

SEQ ID NO: 59475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtctttaatccatcttga

SEQ ID NO: 59476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttaagtctttaatccat

SEQ ID NO: 59477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatttaagtctttaatcca

SEQ ID NO: 59478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcttacatttaagtcttt

SEQ ID NO: 59479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtcttacatttaagtctt

SEQ ID NO: 59480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtcttacatttaagtct

SEQ ID NO: 59481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggttttaggtcttacattt

SEQ ID NO: 59482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggttttaggtcttacatt

SEQ ID NO: 59483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggttttaggtcttacat

SEQ ID NO: 59484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggttttaggtcttaca

SEQ ID NO: 59485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtttttatggttttaggt

SEQ ID NO: 59486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggtttttatggttttag

SEQ ID NO: 59487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagggtttttatggtttta

SEQ ID NO: 59488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctagggtttttatggttt

SEQ ID NO: 59489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctagggtttttatggtt

SEQ ID NO: 59490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtttcttctagggttttt

SEQ ID NO: 59491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctagagtttcttctagggt

SEQ ID NO: 59492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgatattgcctagagttt

SEQ ID NO: 59493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcctgaatgatattgcct

SEQ ID NO: 59494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatgcctatgtcctgaat

SEQ ID NO: 59495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccatgcctatgtcctgaa

SEQ ID NO: 59496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccatgcctatgtcctga

SEQ ID NO: 59497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatgaagtctttgcccat

SEQ ID NO: 59498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcatgaagtctttgccca

SEQ ID NO: 59499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtcatgaagtctttgccc

SEQ ID NO: 59500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgttttagtcatgaagtct

SEQ ID NO: 59501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgttttagtcatgaagtc

SEQ ID NO: 59502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgttttagtcatgaagt

SEQ ID NO: 59503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggtgttttagtcatgaag

SEQ ID NO: 59504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttggtgttttagtcatg

SEQ ID NO: 59505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattgcttttggtgtttta

SEQ ID NO: 59506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgccattgcttttggtgtt

SEQ ID NO: 59507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgccattgcttttggtgt

SEQ ID NO: 59508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgccattgcttttggtg

SEQ ID NO: 59509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttgccattgcttttggt

SEQ ID NO: 59510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttttgttgccattgcttt

SEQ ID NO: 59511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttttgttgccattgctt

SEQ ID NO: 59512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcttttgttgccattgct

SEQ ID NO: 59513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttggcttttgttgccatt

SEQ ID NO: 59514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgttttggcttttgttgc

SEQ ID NO: 59515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgttttggcttttgttg

SEQ ID NO: 59516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcccatttgtctgttttg

SEQ ID NO: 59517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagatcccatttgtctgt

SEQ ID NO: 59518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattagatcccatttgtctg

SEQ ID NO: 59519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttaattagatcccatttg

SEQ ID NO: 59520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttaattagatcccattt

SEQ ID NO: 59521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttaattagatcccatt

SEQ ID NO: 59522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagtttaattagatccca

SEQ ID NO: 59523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaagctctttagtttaat

SEQ ID NO: 59524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagaagctctttagtttaa

SEQ ID NO: 59525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcagaagctctttagttta

SEQ ID NO: 59526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgcagaagctctttagt

SEQ ID NO: 59527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctttgcagaagctctttag

SEQ ID NO: 59528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctttgcagaagctcttta

SEQ ID NO: 59529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctttgcagaagctcttt

SEQ ID NO: 59530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgctttgcagaagctct

SEQ ID NO: 59531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgctttgcagaagctc

SEQ ID NO: 59532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgatagtttcttttgcttt

SEQ ID NO: 59533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgatagtttcttttgct

SEQ ID NO: 59534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctgatgatagtttcttt

SEQ ID NO: 59535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcactctgatgatagtttc

SEQ ID NO: 59536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgttcactctgatgatag

SEQ ID NO: 59537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggttgcctgttcactctg

SEQ ID NO: 59538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaggttgcctgttcactc

SEQ ID NO: 59539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattctgtaggttgcctgt

SEQ ID NO: 59540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccattctgtaggttgcct

SEQ ID NO: 59541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccattctgtaggttgcc

SEQ ID NO: 59542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccattctgtaggttgc

SEQ ID NO: 59543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaaattttctcccattct

SEQ ID NO: 59544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagatggataaattgcaaa

SEQ ID NO: 59545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagatggataaattgcaa

SEQ ID NO: 59546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcagatggataaattgca

SEQ ID NO: 59547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtcagatggataaattgc

SEQ ID NO: 59548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcccttttgtcagatggata

SEQ ID NO: 59549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatattagcccttttgtcag

SEQ ID NO: 59550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatattagcccttttgtc

SEQ ID NO: 59551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagattctggatattagccc

SEQ ID NO: 59552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagattctggatattagcc

SEQ ID NO: 59553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtagattctggatattagc

SEQ ID NO: 59554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtagattctggatatta

SEQ ID NO: 59555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttctttgtagattctgga

SEQ ID NO: 59556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttctttgtagattctgg

SEQ ID NO: 59557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaagttctttgtagattc

SEQ ID NO: 59558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttaagttctttgtagatt

SEQ ID NO: 59559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatttgtttaagttcttt

SEQ ID NO: 59560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaatttgtttaagttctt

SEQ ID NO: 59561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtaaatttgtttaagttc

SEQ ID NO: 59562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtaaatttgtttaagtt

SEQ ID NO: 59563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgtaaatttgtttaagt

SEQ ID NO: 59564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgtaaatttgtttaag

SEQ ID NO: 59565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttgtaaatttgtttaa

SEQ ID NO: 59566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttgtaaatttgttta

SEQ ID NO: 59567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttttcttgtaaatttgt

SEQ ID NO: 59568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttttcttgtaaatttg

SEQ ID NO: 59569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttttttcttgtaaat

SEQ ID NO: 59570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggagttgtttgttttttt

SEQ ID NO: 59571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatggagttgtttgtttttt

SEQ ID NO: 59572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatggagttgtttgttttt

SEQ ID NO: 59573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatggagttgtttgtttt

SEQ ID NO: 59574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgatggagttgtttgttt

SEQ ID NO: 59575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccactttttgatggagttg

SEQ ID NO: 59576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccactttttgatggagtt

SEQ ID NO: 59577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccactttttgatggagt

SEQ ID NO: 59578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcctttgcccacttttt

SEQ ID NO: 59579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatatcctttgcccactt

SEQ ID NO: 59580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagtacctgttcatatcc

SEQ ID NO: 59581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagtacctgttcatatc

SEQ ID NO: 59582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaagtacctgttcatat

SEQ ID NO: 59583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagaagtacctgttcata

SEQ ID NO: 59584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgagaagtacctgttca

SEQ ID NO: 59585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgagaagtacctgttc

SEQ ID NO: 59586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataaatgtcttcttttgag

SEQ ID NO: 59587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgcataaatgtcttcttt

SEQ ID NO: 59588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggctgcataaatgtcttc

SEQ ID NO: 59589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgtctgttggctgcata

SEQ ID NO: 59590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgtctgttggctgcat

SEQ ID NO: 59591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatgtctgttggctgca

SEQ ID NO: 59592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatatgtctgttggctgc

SEQ ID NO: 59593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatatgtctgttggctg

SEQ ID NO: 59594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaccagtgatgatgagca

SEQ ID NO: 59595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgaccagtgatgatgag

SEQ ID NO: 59596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgatgaccagtgatgatg

SEQ ID NO: 59597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgatgaccagtgatgat

SEQ ID NO: 59598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttctctgatgaccagtg

SEQ ID NO: 59599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtttctctgatgaccagt

SEQ ID NO: 59600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgtgtttctctgatgac

SEQ ID NO: 59601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgtgtttctctgatga

SEQ ID NO: 59602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgtgtttctctgatg

SEQ ID NO: 59603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttttgatttgtgtttct

SEQ ID NO: 59604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgtggttttgatttgtgt

SEQ ID NO: 59605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatgaggtggtatctcatt

SEQ ID NO: 59606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attggcatgaggtggtatct

SEQ ID NO: 59607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattggcatgaggtggtat

SEQ ID NO: 59608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattctaattggcatgagg

SEQ ID NO: 59609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgattgccattctaattgg

SEQ ID NO: 59610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgattgccattctaattg

SEQ ID NO: 59611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgattgccattctaatt

SEQ ID NO: 59612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtgattgccattctaat

SEQ ID NO: 59613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagtgattgccattctaa

SEQ ID NO: 59614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actttttagtgattgccatt

SEQ ID NO: 59615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgactttttagtgattgcc

SEQ ID NO: 59616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgactttttagtgattgc

SEQ ID NO: 59617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcctgactttttagtgat

SEQ ID NO: 59618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtttcctgactttttagt

SEQ ID NO: 59619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caacatctgttgtttcctga

SEQ ID NO: 59620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaacatctgttgtttcct

SEQ ID NO: 59621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatcctctccaacatctg

SEQ ID NO: 59622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacatcctctccaacatc

SEQ ID NO: 59623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacatcctctccaacat

SEQ ID NO: 59624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctccacatcctctccaa

SEQ ID NO: 59625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatttctccacatcctctc

SEQ ID NO: 59626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accaacagtgtaaaagcgtt

SEQ ID NO: 59627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaccaacagtgtaaaagcg

SEQ ID NO: 59628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactctcaccaacagtgtaa

SEQ ID NO: 59629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactctcaccaacagtgta

SEQ ID NO: 59630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacactctcaccaacagtgt

SEQ ID NO: 59631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttacactctcaccaacag

SEQ ID NO: 59632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactattttacactctcacc

SEQ ID NO: 59633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacaatggttgaactatttt

SEQ ID NO: 59634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacaatggttgaactattt

SEQ ID NO: 59635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttccacaatggttgaact

SEQ ID NO: 59636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaatcatcacactgtctt

SEQ ID NO: 59637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggaatcatcacactgtct

SEQ ID NO: 59638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaggaatcatcacactgt

SEQ ID NO: 59639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattcttgaggaatcatcac

SEQ ID NO: 59640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattcttgaggaatcatca

SEQ ID NO: 59641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagattcttgaggaatcatc

SEQ ID NO: 59642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttagattcttgaggaat

SEQ ID NO: 59643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttttagattcttgagga

SEQ ID NO: 59644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagttttagattcttgagg

SEQ ID NO: 59645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtcaaatggtatttctagt

SEQ ID NO: 59646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgggtcaaatggtatttct

SEQ ID NO: 59647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtatatacccagtaatgag

SEQ ID NO: 59648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtatatacccagtaatga

SEQ ID NO: 59649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatcccttgagtatatacc

SEQ ID NO: 59650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatcccttgagtatatac

SEQ ID NO: 59651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtagcatgatttacaatc

SEQ ID NO: 59652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtagcatgatttacaat

SEQ ID NO: 59653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagtagcatgatttacaa

SEQ ID NO: 59654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caataaatatacatatgcat

SEQ ID NO: 59655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatagtgctgcaataaat

SEQ ID NO: 59656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgaatagtgctgcaata

SEQ ID NO: 59657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattgtgaatagtgctgca

SEQ ID NO: 59658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattgtgaatagtgctgc

SEQ ID NO: 59659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctattgtgaatagtgctg

SEQ ID NO: 59660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtctttgctattgtgaa

SEQ ID NO: 59661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccaagtctttgctattg

SEQ ID NO: 59662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttggttccaagtctttgc

SEQ ID NO: 59663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttggttccaagtctttg

SEQ ID NO: 59664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggacatttgggttggttc

SEQ ID NO: 59665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatggacatttgggttgg

SEQ ID NO: 59666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttattgatggacatttgggt

SEQ ID NO: 59667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccagtctattattgatgga

SEQ ID NO: 59668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccagtctattattgatgg

SEQ ID NO: 59669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatccagtctattattgatg

SEQ ID NO: 59670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatccagtctattattga

SEQ ID NO: 59671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttatccagtctattattg

SEQ ID NO: 59672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttatccagtctattatt

SEQ ID NO: 59673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catggtgtatatatgccaca

SEQ ID NO: 59674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catagtattccatggtgtat

SEQ ID NO: 59675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctgcatagtattccatg

SEQ ID NO: 59676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggctgcatagtattccat

SEQ ID NO: 59677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggctgcatagtattcca

SEQ ID NO: 59678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggctgcatagtattcc

SEQ ID NO: 59679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatggctgcatagtattc

SEQ ID NO: 59680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttatggctgcatagtatt

SEQ ID NO: 59681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atccttttttatggctgcat

SEQ ID NO: 59682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaggacatgaactcatcc

SEQ ID NO: 59683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcatgtccctacaaagga

SEQ ID NO: 59684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgcatgtccctacaaagg

SEQ ID NO: 59685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcttcatgcatgtcccta

SEQ ID NO: 59686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagcttcatgcatgtccct

SEQ ID NO: 59687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatgatggtttccagctt

SEQ ID NO: 59688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgagaatgatggtttccag

SEQ ID NO: 59689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgagaatgatggtttcca

SEQ ID NO: 59690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgagaatgatggtttcc

SEQ ID NO: 59691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatattttgctgagaatga

SEQ ID NO: 59692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgatattttgctgagaatg

SEQ ID NO: 59693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtccttgtgatattttgct

SEQ ID NO: 59694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgtccttgtgatattttgc

SEQ ID NO: 59695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgtccttgtgatattttg

SEQ ID NO: 59696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttccgtccttgtgatat

SEQ ID NO: 59697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttccgtccttgtgata

SEQ ID NO: 59698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagtgagaacatgcagagt

SEQ ID NO: 59699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgagtgagaacatgcagag

SEQ ID NO: 59700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacttatgagtgagaacat

SEQ ID NO: 59701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactcccacttatgagtgag

SEQ ID NO: 59702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaactcccacttatgagt

SEQ ID NO: 59703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgttcaactcccacttat

SEQ ID NO: 59704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattgttcaactcccactt

SEQ ID NO: 59705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtccatgtgttctcattgt

SEQ ID NO: 59706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgtgtccatgtgttctca

SEQ ID NO: 59707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctccctgtgtccatgtgt

SEQ ID NO: 59708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtgtgatgttcccctccc

SEQ ID NO: 59709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccctggtgtgtgatgttcc

SEQ ID NO: 59710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgcccctggtgtgtgatg

SEQ ID NO: 59711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaccccctaactgcccct

SEQ ID NO: 59712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagctcccaacccccta

SEQ ID NO: 59713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaatccctcccaaagctc

SEQ ID NO: 59714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaagtaatccctcccaaag

SEQ ID NO: 59715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctaagtaatccctcccaa

SEQ ID NO: 59716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctaagtaatccctccca

SEQ ID NO: 59717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatttctcctaagtaatc

SEQ ID NO: 59718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaggtatttctcctaag

SEQ ID NO: 59719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattaggtatttctcctaa

SEQ ID NO: 59720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcatttacattaggtattt

SEQ ID NO: 59721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caccaatcaactcatcattt

SEQ ID NO: 59722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcaccaatcaactcatca

SEQ ID NO: 59723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgcaccaatcaactcatc

SEQ ID NO: 59724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttgctgcaccaatcaact

SEQ ID NO: 59725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataggtatacatgtaccat

SEQ ID NO: 59726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacataggtatacatgtac

SEQ ID NO: 59727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttacataggtatacatgta

SEQ ID NO: 59728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtacatgtgcaaaacatg

SEQ ID NO: 59729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggtacatgtgcaaaaca

SEQ ID NO: 59730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttctagggtacatgtgca

SEQ ID NO: 59731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttctagggtacatgtgc

SEQ ID NO: 59732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagttctagggtacatgtg

SEQ ID NO: 59733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactttaagttctagggtac

SEQ ID NO: 59734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatactttaagttctaggg

SEQ ID NO: 59735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattatactttaagttcta

SEQ ID NO: 59736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattatactttaagttct

SEQ ID NO: 59737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattattatactttaagttc

SEQ ID NO: 59738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattattatactttaagtt

SEQ ID NO: 59739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattattatactttaagt

SEQ ID NO: 59740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttattattatactttaag

SEQ ID NO: 59741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttattattatactttaa

SEQ ID NO: 59742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttattattatacttt

SEQ ID NO: 59743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctttttttattattatac

SEQ ID NO: 59744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgtagcccctattctttt

SEQ ID NO: 59745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtatgtagcccctattct

SEQ ID NO: 59746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttattgtatgtagccccta

SEQ ID NO: 59747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttattgtatgtagcccct

SEQ ID NO: 59748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttattgtatgtagcccc

SEQ ID NO: 59749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacaattttggttattgta

SEQ ID NO: 59750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgaatataaaattaata

SEQ ID NO: 59751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaaaggaataatggtata

SEQ ID NO: 59752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaaaggaataatggtat

SEQ ID NO: 59753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtaaaggaataatggta

SEQ ID NO: 59754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtaaaggaataatggt

SEQ ID NO: 59755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatgtaaaggaataatgg

SEQ ID NO: 59756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttttatgtaaaggaata

SEQ ID NO: 59757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattcattttttatgtaaag

SEQ ID NO: 59758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattcattttttatgtaaa

SEQ ID NO: 59759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttatattcattttttatg

SEQ ID NO: 59760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttatattcattttttat

SEQ ID NO: 59761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtttatattcatttttta

SEQ ID NO: 59762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattttagtttatattcat

SEQ ID NO: 59763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatagagatatagaaatgt

SEQ ID NO: 59764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaatagagatatagaaatg

SEQ ID NO: 59765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaaatagagatatagaaa

SEQ ID NO: 59766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgaaatagagatatagaa

SEQ ID NO: 59767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaggtagtcaaagagttt

SEQ ID NO: 59768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattaaaaaggtagtcaaa

SEQ ID NO: 59769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaattaaaaaggtagtcaa

SEQ ID NO: 59770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttagaattaaaaaggtagt

SEQ ID NO: 59771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttagaattaaaaaggtag

SEQ ID NO: 59772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttagaattaaaaaggta

SEQ ID NO: 59773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatcctttatttagaatta

SEQ ID NO: 59774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttgaaatcctttatttag

SEQ ID NO: 59775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgttgaaatcctttattta

SEQ ID NO: 59776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatccaataaagtgtttat

SEQ ID NO: 59777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaggataatgttgacatc

SEQ ID NO: 59778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatctatcaaggataatg

SEQ ID NO: 59779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtacctagaaatctatcaa

SEQ ID NO: 59780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcagtacctagaaatctat

SEQ ID NO: 59781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcagtacctagaaatcta

SEQ ID NO: 59782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataacttcctcagtacctag

SEQ ID NO: 59783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtatgataattgataactt

SEQ ID NO: 59784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtatgataattgataact

SEQ ID NO: 59785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttgggtatgataattga

SEQ ID NO: 59786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtttgggtatgataattg

SEQ ID NO: 59787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagtccttcagtttgggt

SEQ ID NO: 59788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaatcaattggaaagtcc

SEQ ID NO: 59789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaatcaattggaaagtc

SEQ ID NO: 59790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtaatcaattggaaagt

SEQ ID NO: 59791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgtaatcaattggaaag

SEQ ID NO: 59792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttatgtaatcaattggaa

SEQ ID NO: 59793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttatgtaatcaattgga

SEQ ID NO: 59794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttatgtaatcaattgg

SEQ ID NO: 59795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttcttttatgtaatca

SEQ ID NO: 59796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttatattttcttttat

SEQ ID NO: 59797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagttatattttctttta

SEQ ID NO: 59798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagttatattttctttt

SEQ ID NO: 59799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttaaaagttatatttt

SEQ ID NO: 59800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaattttaaaagttatat

SEQ ID NO: 59801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgttgaattttaaaagtta

SEQ ID NO: 59802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgttgaattttaaaagtt

SEQ ID NO: 59803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttactgttgaattttaaaa

SEQ ID NO: 59804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttatttactgttgaattt

SEQ ID NO: 59805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgttatgttatttactgt

SEQ ID NO: 59806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatgttatgttatttactg

SEQ ID NO: 59807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttagatgttatgttattt

SEQ ID NO: 59808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtcaaaaacctcatttag

SEQ ID NO: 59809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagtcaaaaacctcattta

SEQ ID NO: 59810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagtcaaaaacctcattt

SEQ ID NO: 59811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccagtcaaaaacctcatt

SEQ ID NO: 59812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcttttccagtcaaaaacc

SEQ ID NO: 59813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcttttccagtcaaaaac

SEQ ID NO: 59814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagatttaggcttttccag

SEQ ID NO: 59815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagatttaggcttttcca

SEQ ID NO: 59816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaagatttaggcttttcc

SEQ ID NO: 59817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcccccctttgtaagattta

SEQ ID NO: 59818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagcccccctttgtaagatt

SEQ ID NO: 59819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagcccccctttgtaagat

SEQ ID NO: 59820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagcttctagcccccctttg

SEQ ID NO: 59821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagagaacaaagggagcaa

SEQ ID NO: 59822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaattagcagagaacaaa

SEQ ID NO: 59823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaaattagcagagaacaa

SEQ ID NO: 59824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttaagaaattagcagaga

SEQ ID NO: 59825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagctaacttaagaaattag

SEQ ID NO: 59826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagctaacttaagaaatta

SEQ ID NO: 59827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaacttacagctaactta

SEQ ID NO: 59828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtagaatatacataaatc

SEQ ID NO: 59829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagactaatgtagaatatac

SEQ ID NO: 59830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaggtgaaattatagact

SEQ ID NO: 59831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaggtgaaattatagac

SEQ ID NO: 59832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacttaaaaaggtgaaatt

SEQ ID NO: 59833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgtgacttaaaaaggtg

SEQ ID NO: 59834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgctgtgacttaaaaaggt

SEQ ID NO: 59835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttatgctgtgacttaaaa

SEQ ID NO: 59836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactaatttatgctgtgact

SEQ ID NO: 59837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggattatactaatttat

SEQ ID NO: 59838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatatggattatactaat

SEQ ID NO: 59839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattatatggattatactaa

SEQ ID NO: 59840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaattatatggattatact

SEQ ID NO: 59841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaataaattcttaattata

SEQ ID NO: 59842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaataaattcttaattat

SEQ ID NO: 59843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaatccttgaaaataaatt

SEQ ID NO: 59844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaactataaatccttgaaa

SEQ ID NO: 59845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaatgatctcagaactat

SEQ ID NO: 59846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagttaagtaatgatctca

SEQ ID NO: 59847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcaccctacaagttaagt

SEQ ID NO: 59848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attccagcaccctacaagtt

SEQ ID NO: 59849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattccagcaccctacaagt

SEQ ID NO: 59850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattccagcaccctacaag

SEQ ID NO: 59851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaatccaagagaataaag

SEQ ID NO: 59852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatattaccaaatccaagag

SEQ ID NO: 59853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaataagtaaataagag

SEQ ID NO: 59854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatagcaaacaattaaaaaa

SEQ ID NO: 59855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccattcaatagcaaacaatt

SEQ ID NO: 59856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccattcaatagcaaacaat

SEQ ID NO: 59857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatataatgggaagcttccc

SEQ ID NO: 59858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaataagaaaattcaata

SEQ ID NO: 59859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgaataagaaaattcaat

SEQ ID NO: 59860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgtttgatgaataagaaa

SEQ ID NO: 59861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccattaggtgtttgatgaat

SEQ ID NO: 59862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttaccattaggtgtttgat

SEQ ID NO: 59863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggcagaaagggaagtctgg

SEQ ID NO: 59864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaggcagaaagggaagtct

SEQ ID NO: 59865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catcaaaaacaacaacaaca

SEQ ID NO: 59866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagcaagactccatcaaaa

SEQ ID NO: 59867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcctcagagcaagactcca

SEQ ID NO: 59868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgtgcctcagagcaa

SEQ ID NO: 59869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctgtgcctcag

SEQ ID NO: 59870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagccaagatggtggc

SEQ ID NO: 59871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacccaggaggtggaggttg

SEQ ID NO: 59872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacccaggaggtggaggtt

SEQ ID NO: 59873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgaacccaggaggtggag

SEQ ID NO: 59874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agacatgagaattacttgaa

SEQ ID NO: 59875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggctgagacatgagaat

SEQ ID NO: 59876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaggctgagacatgagaa

SEQ ID NO: 59877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgggaggctgagacatga

SEQ ID NO: 59878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagctacttgggag

SEQ ID NO: 59879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtggtggcatgcacctgt

SEQ ID NO: 59880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctgatgtggtggcatgca

SEQ ID NO: 59881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaattagcctg

SEQ ID NO: 59882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaattagc

SEQ ID NO: 59883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaatacaaaaatta

SEQ ID NO: 59884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctactaaaaatacaaaa

SEQ ID NO: 59885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaccagaccagccaacat

SEQ ID NO: 59886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggccaggagttcaaaacca

SEQ ID NO: 59887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggccaggagttcaaaacc

SEQ ID NO: 59888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagatcacttgaggccagg

SEQ ID NO: 59889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccaaggctggcagat

SEQ ID NO: 59890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccaaggctggcaga

SEQ ID NO: 59891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccaaggctggcag

SEQ ID NO: 59892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagcactttgggag

SEQ ID NO: 59893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgcctgtaatcccagcact

SEQ ID NO: 59894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtggccggatatggtggc

SEQ ID NO: 59895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaggtggccggatatggtg

SEQ ID NO: 59896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacactctaaggtggccgg

SEQ ID NO: 59897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattaaaacactctaaggtg

SEQ ID NO: 59898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagaggaaagctgaatta

SEQ ID NO: 59899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catattaaatagaggaaagc

SEQ ID NO: 59900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataaagactgcatattaaa

SEQ ID NO: 59901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagtaggtgagatgaatat

SEQ ID NO: 59902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccagtaggtgagatgaata

SEQ ID NO: 59903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgccttgccagtaggtgag

SEQ ID NO: 59904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatgccttgccagtaggtg

SEQ ID NO: 59905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcatgccttgccagtagg

SEQ ID NO: 59906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctctcatgccttgccag

SEQ ID NO: 59907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatgaagtctgtctctctc

SEQ ID NO: 59908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acattgacatgaagtctgtc

SEQ ID NO: 59909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacattgacatgaagtctgt

SEQ ID NO: 59910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgacattgacatgaagtct

SEQ ID NO: 59911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgacattgacatgaagt

SEQ ID NO: 59912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttgacattgacatgaag

SEQ ID NO: 59913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtttctcttgacattgaca

SEQ ID NO: 59914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaacagtaaaggatctgg

SEQ ID NO: 59915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtccccattaatgaacagt

SEQ ID NO: 59916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtccccattaatgaacag

SEQ ID NO: 59917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtccccattaatgaaca

SEQ ID NO: 59918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taattttcagtccccattaa

SEQ ID NO: 59919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatgctgtaattttcagtc

SEQ ID NO: 59920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcatgctgtaattttcagt

SEQ ID NO: 59921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcatgctgtaattttca

SEQ ID NO: 59922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaagttcttggcatgctgt

SEQ ID NO: 59923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcaagttcttggcatgct

SEQ ID NO: 59924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtcaagttcttggcatgc

SEQ ID NO: 59925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgtcaagttcttggcat

SEQ ID NO: 59926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctgtcaagttcttggca

SEQ ID NO: 59927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcttcttctgtcaagttc

SEQ ID NO: 59928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagcttcttctgtcaagt

SEQ ID NO: 59929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccagcttcttctgtcaag

SEQ ID NO: 59930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctccagcttcttctgtcaa

SEQ ID NO: 59931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctccagcttcttctgtca

SEQ ID NO: 59932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtttttctccagcttcttc

SEQ ID NO: 59933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcagtttttctccagcttc

SEQ ID NO: 59934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctcagtttttctccagct

SEQ ID NO: 59935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctcagtttttctccagc

SEQ ID NO: 59936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcctcagtttttctccag

SEQ ID NO: 59937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagttttctcctcagttttt

SEQ ID NO: 59938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagttggagttttctcctc

SEQ ID NO: 59939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagttggagttttctcct

SEQ ID NO: 59940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcaaagttggagttttctc

SEQ ID NO: 59941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcaaagttggagttttc

SEQ ID NO: 59942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttcaaagttggagtttt

SEQ ID NO: 59943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcttcaaagttggagttt

SEQ ID NO: 59944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttctcttcaaagttgga

SEQ ID NO: 59945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattttctcttcaaagttgg

SEQ ID NO: 59946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgattttctcttcaaagttg

SEQ ID NO: 59947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgattttctcttcaaag

SEQ ID NO: 59948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactttgattttctcttca

SEQ ID NO: 59949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggaaaacaaaatctatta

SEQ ID NO: 59950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaccaggatatcattagg

SEQ ID NO: 59951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatattgacaaccaggat

SEQ ID NO: 59952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcatattgacaaccagga

SEQ ID NO: 59953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatcatattgacaaccag

SEQ ID NO: 59954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccattcttcatcatattg

SEQ ID NO: 59955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcccattcttcatcatatt

SEQ ID NO: 59956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcccattcttcatcatat

SEQ ID NO: 59957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttttatcccattcttcatc

SEQ ID NO: 59958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagttttatcccattcttc

SEQ ID NO: 59959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctattagttttatcccattc

SEQ ID NO: 59960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatctcctattagtttta

SEQ ID NO: 59961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcataatctcctattagt

SEQ ID NO: 59962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattaattcataatctccta

SEQ ID NO: 59963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgaattaattcataatctc

SEQ ID NO: 59964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattgaattaattcataatc

SEQ ID NO: 59965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctattgaattaattcataa

SEQ ID NO: 59966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctattgaattaattcata

SEQ ID NO: 59967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggaaaacaaaacacccac

SEQ ID NO: 59968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataagctataggaaaacaa

SEQ ID NO: 59969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacaaggcctaaataagcta

SEQ ID NO: 59970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacaaggcctaaataagct

SEQ ID NO: 59971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcacaaggcctaaataagc

SEQ ID NO: 59972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagggatacattttgcacaa

SEQ ID NO: 59973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagggatacattttgcaca

SEQ ID NO: 59974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagggatacattttgcac

SEQ ID NO: 59975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggttttaaagggatacattt

SEQ ID NO: 59976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacctaggttttaaagggat

SEQ ID NO: 59977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacctaggttttaaaggga

SEQ ID NO: 59978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccacctaggttttaaag

SEQ ID NO: 59979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaattccttccacctagg

SEQ ID NO: 59980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagaattccttccacctag

SEQ ID NO: 59981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttacagaattccttccac

SEQ ID NO: 59982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcctgacttacagaattcct

SEQ ID NO: 59983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacacagaaaaaaactagc

SEQ ID NO: 59984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgtagattgtaacacaga

SEQ ID NO: 59985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtaatacagcctcaatgta

SEQ ID NO: 59986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatgtaatacagcctcaat

SEQ ID NO: 59987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactatgtaatacagcctc

SEQ ID NO: 59988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactatgtaatacagcct

SEQ ID NO: 59989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattactatgtaatacagcc

SEQ ID NO: 59990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaccagaagtgaagaagtc

SEQ ID NO: 59991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaaagatgatctgacacc

SEQ ID NO: 59992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacaaagatgatctgacac

SEQ ID NO: 59993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccaaggacaaaagaaagga

SEQ ID NO: 59994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acccaaggacaaaagaaagg

SEQ ID NO: 59995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaacttacccaaggacaa

SEQ ID NO: 59996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaattaagaaacttaccc

SEQ ID NO: 59997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagaattaagaaacttacc

SEQ ID NO: 59998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaaagaattaagaaactt

SEQ ID NO: 59999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttaaagaattaagaaact

SEQ ID NO: 60000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttaaagaattaagaaac

SEQ ID NO: 60001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgatgaggtggttttac

SEQ ID NO: 60002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatgatgaggtggtttta

SEQ ID NO: 60003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttataatgatgaggtggttt

SEQ ID NO: 60004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcttataatgatgaggtgg

SEQ ID NO: 60005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaaacacaaatgcagtga

SEQ ID NO: 60006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagcaaacacaaatgcagt

SEQ ID NO: 60007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcagcaaacacaaatgcag

SEQ ID NO: 60008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttctcagcaaacacaaat

SEQ ID NO: 60009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttctcagcaaacacaaa

SEQ ID NO: 60010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttatcttctcagcaaac

SEQ ID NO: 60011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcaatttatcttctcagc

SEQ ID NO: 60012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcattacctcaatttatc

SEQ ID NO: 60013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgcattacctcaatttat

SEQ ID NO: 60014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatgcattacctcaattt

SEQ ID NO: 60015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtattcttcatgcattacc

SEQ ID NO: 60016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctaagtattcttcatgca

SEQ ID NO: 60017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatgtgccagatattatgc

SEQ ID NO: 60018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accatgtgccagatattatg

SEQ ID NO: 60019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaagacttaccatgtgcc

SEQ ID NO: 60020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaagacttaccatgtgc

SEQ ID NO: 60021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatttaatgaagacttacc

SEQ ID NO: 60022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagcaccaacagtaatagt

SEQ ID NO: 60023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagcaccaacagtaatag

SEQ ID NO: 60024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaggaagtttaatagcacc

SEQ ID NO: 60025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcaggaagtttaatagcac

SEQ ID NO: 60026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcttatcaggaagtttaat

SEQ ID NO: 60027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatcttatcaggaagttta

SEQ ID NO: 60028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actctcatcttatcaggaag

SEQ ID NO: 60029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaactctcatcttatcag

SEQ ID NO: 60030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattaactctcatcttatca

SEQ ID NO: 60031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttcattaactctcatctt

SEQ ID NO: 60032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaataacctcatttcatta

SEQ ID NO: 60033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggagtaaatgttaacaata

SEQ ID NO: 60034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaactatggagtaaatgt

SEQ ID NO: 60035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcaactatggagtaaatg

SEQ ID NO: 60036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatttgagcaactatgga

SEQ ID NO: 60037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgatatacaaatatataa

SEQ ID NO: 60038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaaggaagattacatga

SEQ ID NO: 60039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttataaaaaggaagatt

SEQ ID NO: 60040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgagttcaagttataaaaa

SEQ ID NO: 60041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacaaaagtcattaatgag

SEQ ID NO: 60042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagaacaaaagtcattaat

SEQ ID NO: 60043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctattagaacaaaagtcatt

SEQ ID NO: 60044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatcataaaacatactac

SEQ ID NO: 60045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatcataaaacatacta

SEQ ID NO: 60046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataatcataaaacatact

SEQ ID NO: 60047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaataatcataaaacatac

SEQ ID NO: 60048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttttaataatcataaaac

SEQ ID NO: 60049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgaaattagtttttaat

SEQ ID NO: 60050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtgaaattagtttttaa

SEQ ID NO: 60051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgatttcatgtgaaattag

SEQ ID NO: 60052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatgatttcatgtgaaatt

SEQ ID NO: 60053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctctaatgatttcatgtg

SEQ ID NO: 60054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctctaatgatttcatgt

SEQ ID NO: 60055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctctaatgatttcatg

SEQ ID NO: 60056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcacctctaatgatttcat

SEQ ID NO: 60057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcacctctaatgatttca

SEQ ID NO: 60058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcacctctaatgatttc

SEQ ID NO: 60059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataagtacttttttcacctc

SEQ ID NO: 60060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatcctcataagtacttt

SEQ ID NO: 60061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcatcatcctcataagtac

SEQ ID NO: 60062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caactattcatcatcctcat

SEQ ID NO: 60063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaactattcatcatcctca

SEQ ID NO: 60064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaactattcatcatcctc

SEQ ID NO: 60065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaactattcatcatcct

SEQ ID NO: 60066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttttccaactattcatca

SEQ ID NO: 60067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagtttttccaactattca

SEQ ID NO: 60068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actagtttttccaactattc

SEQ ID NO: 60069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactagtttttccaactatt

SEQ ID NO: 60070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttactagtttttccaact

SEQ ID NO: 60071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaccaaccctattttact

SEQ ID NO: 60072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taataaccaaccctatttta

SEQ ID NO: 60073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaataaccaaccctatttt

SEQ ID NO: 60074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaataaccaaccctattt

SEQ ID NO: 60075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctaataaccaaccctat

SEQ ID NO: 60076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccatgcctctttctaataa

SEQ ID NO: 60077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaactacccatgcctcttt

SEQ ID NO: 60078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatcaactacccatgcctct

SEQ ID NO: 60079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctctatcaactacccat

SEQ ID NO: 60080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atggctctatcaactaccca

SEQ ID NO: 60081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaaagcttatggctctat

SEQ ID NO: 60082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcaaagcttatggctcta

SEQ ID NO: 60083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataatttgatcaaagctta

SEQ ID NO: 60084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caataatttgatcaaagctt

SEQ ID NO: 60085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttcaataatttgatcaaa

SEQ ID NO: 60086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttcaataatttgatcaa

SEQ ID NO: 60087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacttcaataatttgatca

SEQ ID NO: 60088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacttcaataatttgatc

SEQ ID NO: 60089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaacttcaataatttgat

SEQ ID NO: 60090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttttaacttcaataattt

SEQ ID NO: 60091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgctttttaacttcaataa

SEQ ID NO: 60092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgctttttaacttcaata

SEQ ID NO: 60093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccacttactgctttttaact

SEQ ID NO: 60094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacaatgcaatgttgccact

SEQ ID NO: 60095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacaatgcaatgttgccac

SEQ ID NO: 60096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccacaatgcaatgttgcca

SEQ ID NO: 60097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccacaatgcaatgttgcc

SEQ ID NO: 60098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaacccatatcttttccac

SEQ ID NO: 60099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaacccatatcttttcca

SEQ ID NO: 60100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgaaaacccatatcttt

SEQ ID NO: 60101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgaaaacccatatctt

SEQ ID NO: 60102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgatttgaaaacccatat

SEQ ID NO: 60103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgcctgtttgatttgaa

SEQ ID NO: 60104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgattgaaatgcctgtttga

SEQ ID NO: 60105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaccaagtaacaggatacc

SEQ ID NO: 60106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaccaagtaacaggatac

SEQ ID NO: 60107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaaaccaagtaacagga

SEQ ID NO: 60108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaggatggataaattgtt

SEQ ID NO: 60109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcccctagaaaggatggata

SEQ ID NO: 60110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaaaatgaataaattagc

SEQ ID NO: 60111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgaaaatgaataaattag

SEQ ID NO: 60112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtggtatcttgatgaaa

SEQ ID NO: 60113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagtggtatcttgatgaa

SEQ ID NO: 60114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttgaaagtggtatcttga

SEQ ID NO: 60115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcccttgaaagtggtatc

SEQ ID NO: 60116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctcccttgaaagtggta

SEQ ID NO: 60117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctccctcccttgaaagtg

SEQ ID NO: 60118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cactcctctccctcccttga

SEQ ID NO: 60119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtgctccactcctctccc

SEQ ID NO: 60120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgtgctccactcctctcc

SEQ ID NO: 60121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatggcaaggacatttgatg

SEQ ID NO: 60122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgcagcacactgaatggca

SEQ ID NO: 60123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccctagtgcagcacactg

SEQ ID NO: 60124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catatgaggcaagagtgaaa

SEQ ID NO: 60125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgctccatatgaggcaag

SEQ ID NO: 60126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgctccatatgaggcaa

SEQ ID NO: 60127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagtgctccatatgaggca

SEQ ID NO: 60128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcagtgctccatatgagg

SEQ ID NO: 60129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttctttcagtgctccatat

SEQ ID NO: 60130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcatactggttctttcagt

SEQ ID NO: 60131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatcatactggttctttca

SEQ ID NO: 60132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctaatcatactggttctt

SEQ ID NO: 60133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcaattgttctaatcata

SEQ ID NO: 60134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagctgtatcaattgttcta

SEQ ID NO: 60135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagctgtatcaattgttct

SEQ ID NO: 60136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttgtagctgtatcaatt

SEQ ID NO: 60137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatgtttgtagctgtatca

SEQ ID NO: 60138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatgtttgtagctgtatc

SEQ ID NO: 60139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctatgtttgtagctgtat

SEQ ID NO: 60140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcctatgtttgtagctgta

SEQ ID NO: 60141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccgtccccttttcctatgtt

SEQ ID NO: 60142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctaccgtccccttttcct

SEQ ID NO: 60143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacagctaatctaccgtcc

SEQ ID NO: 60144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaaacagctaatctaccgt

SEQ ID NO: 60145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagtctctcaaacagctaa

SEQ ID NO: 60146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagatactgagagtctctca

SEQ ID NO: 60147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctagagatactgagagtct

SEQ ID NO: 60148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagtcagcctggctagaga

SEQ ID NO: 60149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccagtcagcctggctagag

SEQ ID NO: 60150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgccagtcagcctggctaga

SEQ ID NO: 60151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagggcaagacctttgcca

SEQ ID NO: 60152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagggcaagacctttgcc

SEQ ID NO: 60153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacagggcaagacctttgc

SEQ ID NO: 60154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actttgacagggcaagacct

SEQ ID NO: 60155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggactgactttgacagggc

SEQ ID NO: 60156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggactgactttgacaggg

SEQ ID NO: 60157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagccatccgacacaatgt

SEQ ID NO: 60158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagaatagccacctgtcag

SEQ ID NO: 60159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcattggaagaatagccac

SEQ ID NO: 60160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtctgtgcattggaagaa

SEQ ID NO: 60161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattggtgtctgtgcattgg

SEQ ID NO: 60162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattggtgtctgtgcattg

SEQ ID NO: 60163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcattggtgtctgtgcatt

SEQ ID NO: 60164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctttgcattggtgtctgt

SEQ ID NO: 60165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgctttgcattggtgtctg

SEQ ID NO: 60166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtgctttgcattggtgt

SEQ ID NO: 60167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttccttgtgctttgcatt

SEQ ID NO: 60168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgttccttgtgctttgcat

SEQ ID NO: 60169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgttccttgtgctttgca

SEQ ID NO: 60170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtgttccttgtgctttg

SEQ ID NO: 60171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attctttgtgttccttgtgc

SEQ ID NO: 60172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctaattctttgtgttcctt

SEQ ID NO: 60173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctaattctttgtgttcct

SEQ ID NO: 60174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccctaattctttgtgtt

SEQ ID NO: 60175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtttccctaattctttgt

SEQ ID NO: 60176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtttccctaattctttg

SEQ ID NO: 60177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgtttccctaattcttt

SEQ ID NO: 60178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgtttccctaattctt

SEQ ID NO: 60179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgttgtttccctaattct

SEQ ID NO: 60180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccctttttgttgtttccct

SEQ ID NO: 60181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccctttttgttgtttccc

SEQ ID NO: 60182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccctttttgttgtttcc

SEQ ID NO: 60183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatccctttttgttgtttc

SEQ ID NO: 60184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttatccctttttgttgtt

SEQ ID NO: 60185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttatccctttttgttgt

SEQ ID NO: 60186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cggatttcttttatcccttt

SEQ ID NO: 60187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtcagtaactgcggattt

SEQ ID NO: 60188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggtcagtaactgcggatt

SEQ ID NO: 60189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagggtcagtaactgcggat

SEQ ID NO: 60190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttagggtcagtaactgcgg

SEQ ID NO: 60191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttagggtcagtaactgcg

SEQ ID NO: 60192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctttagggtcagtaact

SEQ ID NO: 60193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttctttagggtcagtaa

SEQ ID NO: 60194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaatctctatttctttagg

SEQ ID NO: 60195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaatctctatttctttag

SEQ ID NO: 60196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaatttataaatctctat

SEQ ID NO: 60197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcaatttataaatctcta

SEQ ID NO: 60198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggcaatttataaatctct

SEQ ID NO: 60199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggcaatttataaatctc

SEQ ID NO: 60200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaggcaatttataaatct

SEQ ID NO: 60201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaggcaatttataaatc

SEQ ID NO: 60202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttaggcaatttataaa

SEQ ID NO: 60203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcttttttaggcaattt

SEQ ID NO: 60204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattcttttttaggcaatt

SEQ ID NO: 60205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattcttttttaggcaat

SEQ ID NO: 60206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgaattcttttttaggc

SEQ ID NO: 60207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggataattattttgaattct

SEQ ID NO: 60208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaggataattattttgaa

SEQ ID NO: 60209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattaggataattattttga

SEQ ID NO: 60210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacttcattaggataattat

SEQ ID NO: 60211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaacttcattaggataat

SEQ ID NO: 60212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaaacttcattaggataa

SEQ ID NO: 60213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctaaacttcattaggata

SEQ ID NO: 60214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtactttgctaaacttcatt

SEQ ID NO: 60215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtactttgctaaacttca

SEQ ID NO: 60216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggtactttgctaaactt

SEQ ID NO: 60217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctctggtactttgctaaa

SEQ ID NO: 60218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttctctggtactttgcta

SEQ ID NO: 60219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctctgttctctggtacttt

SEQ ID NO: 60220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctatctctgttctctggta

SEQ ID NO: 60221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgtctatctctgttctct

SEQ ID NO: 60222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgtctatctctgttctc

SEQ ID NO: 60223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagttgtctatctctgtt

SEQ ID NO: 60224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttagttgtctatctctgt

SEQ ID NO: 60225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttagttgtctatctctg

SEQ ID NO: 60226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttgtttagttgtctatc

SEQ ID NO: 60227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgattttgtttagttgtct

SEQ ID NO: 60228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgattttgtttagttgtc

SEQ ID NO: 60229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtatcatcttcctgattt

SEQ ID NO: 60230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttcatgtatcatcttcct

SEQ ID NO: 60231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgtgttcatgtatcatct

SEQ ID NO: 60232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatcctcattgtgttcatg

SEQ ID NO: 60233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgatatcctcattgtgtt

SEQ ID NO: 60234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgatatcctcattgtgt

SEQ ID NO: 60235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttcattgatatcctcatt

SEQ ID NO: 60236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccttcattgatatcctcat

SEQ ID NO: 60237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccttcattgatatcctca

SEQ ID NO: 60238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcccttcattgatatcct

SEQ ID NO: 60239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcccttcattgatatcc

SEQ ID NO: 60240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtgtgtgtatagtttct

SEQ ID NO: 60241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgtgtgtgtatagtttc

SEQ ID NO: 60242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtgtgtgtgtatagttt

SEQ ID NO: 60243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtgtgtgtgtatagtt

SEQ ID NO: 60244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtgtgtgtgtgtatagt

SEQ ID NO: 60245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttgtgtgtgtgtgta

SEQ ID NO: 60246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactttttgtgtgtgtgtgt

SEQ ID NO: 60247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatttgactttttgtgtgt

SEQ ID NO: 60248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatatttgactttttgtg

SEQ ID NO: 60249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgatatttgactttttgt

SEQ ID NO: 60250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgatatttgactttttg

SEQ ID NO: 60251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgatatttgacttttt

SEQ ID NO: 60252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagtttttactgatattt

SEQ ID NO: 60253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattccagagtttttactga

SEQ ID NO: 60254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattccagagtttttactg

SEQ ID NO: 60255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaattccagagtttttac

SEQ ID NO: 60256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattcttcaattccagagtt

SEQ ID NO: 60257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtattcttcaattccaga

SEQ ID NO: 60258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattattgtattcttcaatt

SEQ ID NO: 60259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcaattattgtattcttc

SEQ ID NO: 60260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttcaattattgtattctt

SEQ ID NO: 60261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttcaattattgtattct

SEQ ID NO: 60262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagttcaattattgtattc

SEQ ID NO: 60263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagttcaattattgtatt

SEQ ID NO: 60264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggagttttttagttcaatt

SEQ ID NO: 60265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagggagttttttagttcaa

SEQ ID NO: 60266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcctctagggagtttttt

SEQ ID NO: 60267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgaatcctctagggagttt

SEQ ID NO: 60268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctattgaatcctctagggag

SEQ ID NO: 60269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaagtctgctattgaatc

SEQ ID NO: 60270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcaagtctgctattgaat

SEQ ID NO: 60271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtttgatcaagtctgcta

SEQ ID NO: 60272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagtttgatcaagtctgc

SEQ ID NO: 60273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccagtttgatcaagtctg

SEQ ID NO: 60274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctccagtttgatcaagtct

SEQ ID NO: 60275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctccagtttgatcaagt

SEQ ID NO: 60276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attctttctccagtttgatc

SEQ ID NO: 60277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgattctttctccagtttg

SEQ ID NO: 60278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgattctttctccagttt

SEQ ID NO: 60279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttgttgattctttctcca

SEQ ID NO: 60280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtttgttgattctttctcc

SEQ ID NO: 60281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggtttgttgattctttct

SEQ ID NO: 60282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggtttgttgattctttc

SEQ ID NO: 60283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttggtttgttgattcttt

SEQ ID NO: 60284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttggtttgttgattctt

SEQ ID NO: 60285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttggtttgttgattct

SEQ ID NO: 60286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttggtttgttgattc

SEQ ID NO: 60287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttttcttggtttgttga

SEQ ID NO: 60288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggggttgtttttttcttg

SEQ ID NO: 60289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatggggttgtttttttctt

SEQ ID NO: 60290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatggggttgtttttttct

SEQ ID NO: 60291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatggggttgtttttttc

SEQ ID NO: 60292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccagtttttgatggggttg

SEQ ID NO: 60293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccagtttttgatggggtt

SEQ ID NO: 60294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacccagtttttgatggggt

SEQ ID NO: 60295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcctttacccagttttt

SEQ ID NO: 60296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatatcctttacccagtt

SEQ ID NO: 60297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagtgtctgttcatatcc

SEQ ID NO: 60298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagtgtctgttcatatc

SEQ ID NO: 60299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaagtgtctgttcatat

SEQ ID NO: 60300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagaagtgtctgttcata

SEQ ID NO: 60301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgagaagtgtctgttca

SEQ ID NO: 60302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgagaagtgtctgttc

SEQ ID NO: 60303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataaatgtcttcttttgag

SEQ ID NO: 60304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgcataaatgtcttcttt

SEQ ID NO: 60305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctgcataaatgtcttctt

SEQ ID NO: 60306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctgcataaatgtcttct

SEQ ID NO: 60307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggctgcataaatgtcttc

SEQ ID NO: 60308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggctgcataaatgtctt

SEQ ID NO: 60309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgttttttggctgcata

SEQ ID NO: 60310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtgttttttggctgcat

SEQ ID NO: 60311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgtgttttttggctgca

SEQ ID NO: 60312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatgtgttttttggctgc

SEQ ID NO: 60313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatgtgttttttggctg

SEQ ID NO: 60314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggccagtgatgatgagca

SEQ ID NO: 60315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatggccagtgatgatgag

SEQ ID NO: 60316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgatggccagtgatgatg

SEQ ID NO: 60317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgatggccagtgatgat

SEQ ID NO: 60318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttctctgatggccagtg

SEQ ID NO: 60319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatttctctgatggccagt

SEQ ID NO: 60320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgcatttctctgatggc

SEQ ID NO: 60321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgcatttctctgatgg

SEQ ID NO: 60322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgcatttctctgatg

SEQ ID NO: 60323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cggttttgatttgcatttct

SEQ ID NO: 60324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgcggttttgatttgcat

SEQ ID NO: 60325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtatgagatggtatctcatt

SEQ ID NO: 60326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actggtatgagatggtatct

SEQ ID NO: 60327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactggtatgagatggtat

SEQ ID NO: 60328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatcaccattctaactgg

SEQ ID NO: 60329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgatcaccattctaactg

SEQ ID NO: 60330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgatcaccattctaact

SEQ ID NO: 60331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgatcaccattctaac

SEQ ID NO: 60332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaatgatcaccattctaa

SEQ ID NO: 60333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actttttaatgatcaccatt

SEQ ID NO: 60334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgactttttaatgatcacc

SEQ ID NO: 60335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgactttttaatgatcac

SEQ ID NO: 60336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcctgactttttaatgat

SEQ ID NO: 60337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtttcctgactttttaat

SEQ ID NO: 60338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcacctgttgtttcctga

SEQ ID NO: 60339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccagcacctgttgtttcct

SEQ ID NO: 60340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatcctctccagcacctg

SEQ ID NO: 60341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacatcctctccagcacc

SEQ ID NO: 60342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacatcctctccagcac

SEQ ID NO: 60343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctccacatcctctccag

SEQ ID NO: 60344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttctccacatcctctc

SEQ ID NO: 60345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtcccaccaacagtgtaa

SEQ ID NO: 60346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagtcccaccaacagtgta

SEQ ID NO: 60347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttacagtcccaccaacag

SEQ ID NO: 60348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactagtttacagtcccacc

SEQ ID NO: 60349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacagtggttgaactagttt

SEQ ID NO: 60350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacagtggttgaactagtt

SEQ ID NO: 60351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaatcgccacacggactt

SEQ ID NO: 60352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggaatcgccacacggact

SEQ ID NO: 60353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatccttgaggaatcgccac

SEQ ID NO: 60354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatccttgaggaatcgcc

SEQ ID NO: 60355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttctagatccttgaggaat

SEQ ID NO: 60356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttctagatccttgagga

SEQ ID NO: 60357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagttctagatccttgagg

SEQ ID NO: 60358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtcaaatggtatttctagt

SEQ ID NO: 60359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtatatacccagtcatggg

SEQ ID NO: 60360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtatatacccagtcatgg

SEQ ID NO: 60361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggtatatacccagtcatg

SEQ ID NO: 60362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatcctttgggtatatacc

SEQ ID NO: 60363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatcctttgggtatatac

SEQ ID NO: 60364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcagcatgatttataatc

SEQ ID NO: 60365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagcagcatgatttataat

SEQ ID NO: 60366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagcagcatgatttataa

SEQ ID NO: 60367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatagtgccgcaataaac

SEQ ID NO: 60368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgaatagtgccgcaata

SEQ ID NO: 60369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattgtgaatagtgccgca

SEQ ID NO: 60370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattgtgaatagtgccgc

SEQ ID NO: 60371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctattgtgaatagtgccg

SEQ ID NO: 60372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtctttgctattgtgaa

SEQ ID NO: 60373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccaagtctttgctattg

SEQ ID NO: 60374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttccaagtctttgctatt

SEQ ID NO: 60375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttggttccaagtctttgc

SEQ ID NO: 60376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttggttccaagtctttg

SEQ ID NO: 60377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacatttggcttggttccaa

SEQ ID NO: 60378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggacatttggcttggttc

SEQ ID NO: 60379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcattgttggacatttggct

SEQ ID NO: 60380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccagtctatcattgttgg

SEQ ID NO: 60381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatccagtctatcattgttg

SEQ ID NO: 60382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatccagtctatcattgt

SEQ ID NO: 60383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaatccagtctatcattg

SEQ ID NO: 60384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaatccagtctatcatt

SEQ ID NO: 60385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catggtgtatatgtgccata

SEQ ID NO: 60386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catagtattccatggtgtat

SEQ ID NO: 60387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctgcatagtattccatg

SEQ ID NO: 60388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggctgcatagtattccat

SEQ ID NO: 60389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggctgcatagtattcca

SEQ ID NO: 60390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggctgcatagtattcc

SEQ ID NO: 60391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatggctgcatagtattc

SEQ ID NO: 60392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttatggctgcatagtatt

SEQ ID NO: 60393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atccttttttatggctgcat

SEQ ID NO: 60394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctcatccttttttatggc

SEQ ID NO: 60395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagctcatccttttttatgg

SEQ ID NO: 60396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaggacttgagctcatcc

SEQ ID NO: 60397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcatgtccctgcaaagga

SEQ ID NO: 60398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgcatgtccctgcaaagg

SEQ ID NO: 60399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcttcatgcatgtccctg

SEQ ID NO: 60400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagcttcatgcatgtccct

SEQ ID NO: 60401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatgatggtttccagctt

SEQ ID NO: 60402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgagaatgatggtttccag

SEQ ID NO: 60403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgagaatgatggtttcca

SEQ ID NO: 60404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgatagtttgctgagaatga

SEQ ID NO: 60405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcgatagtttgctgagaatg

SEQ ID NO: 60406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgcgatagtttgctgaga

SEQ ID NO: 60407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgcgatagtttgctgag

SEQ ID NO: 60408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttgcgatagtttgctga

SEQ ID NO: 60409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccttgcgatagtttgctg

SEQ ID NO: 60410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccttgcgatagtttgct

SEQ ID NO: 60411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttccttgcgatagtttgc

SEQ ID NO: 60412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttttttccttgcgatagt

SEQ ID NO: 60413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttttttccttgcgatag

SEQ ID NO: 60414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagtgagaaagtgcagtgt

SEQ ID NO: 60415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacctatgagtgagaaagt

SEQ ID NO: 60416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattcccacctatgagtgag

SEQ ID NO: 60417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaattcccacctatgagt

SEQ ID NO: 60418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgttcaattcccacctat

SEQ ID NO: 60419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattgttcaattcccacct

SEQ ID NO: 60420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtccatgtgttctcattgt

SEQ ID NO: 60421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtgtccatgtgttctcat

SEQ ID NO: 60422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgtgtccatgtgttctca

SEQ ID NO: 60423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtgtgatggtccccttcc

SEQ ID NO: 60424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccccaccccacaacaggcc

SEQ ID NO: 60425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctccccccaccccacaacag

SEQ ID NO: 60426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatatccccctcctcccc

SEQ ID NO: 60427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgttaggtatatccccctc

SEQ ID NO: 60428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaatgttaggtatatcccc

SEQ ID NO: 60429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatatctcctaatgttag

SEQ ID NO: 60430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattaggtatatctcctaa

SEQ ID NO: 60431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacattaggtatatctccta

SEQ ID NO: 60432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcatttaacattaggtata

SEQ ID NO: 60433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcatcatttaacattagg

SEQ ID NO: 60434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacccattaactcatcattt

SEQ ID NO: 60435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtgctacacccattaact

SEQ ID NO: 60436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatgtatacatgtgccat

SEQ ID NO: 60437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttacatatgtatacatgtg

SEQ ID NO: 60438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtacatgtgcacaacgtg

SEQ ID NO: 60439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggtacatgtgcacaacgt

SEQ ID NO: 60440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggtacatgtgcacaacg

SEQ ID NO: 60441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttttagggtacatgtgca

SEQ ID NO: 60442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttttagggtacatgtgc

SEQ ID NO: 60443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagttttagggtacatgtg

SEQ ID NO: 60444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactttaagttttagggtac

SEQ ID NO: 60445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatactttaagttttaggg

SEQ ID NO: 60446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatactttaagttttagg

SEQ ID NO: 60447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatactttaagttttag

SEQ ID NO: 60448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattatactttaagtttta

SEQ ID NO: 60449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattatactttaagtttt

SEQ ID NO: 60450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttattatactttaagt

SEQ ID NO: 60451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttattatactttaag

SEQ ID NO: 60452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttattatactttaa

SEQ ID NO: 60453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttattatacttta

SEQ ID NO: 60454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttattttttattatact

SEQ ID NO: 60455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttattttttattatac

SEQ ID NO: 60456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttattttttattata

SEQ ID NO: 60457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttttattttttattat

SEQ ID NO: 60458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttttattttttatta

SEQ ID NO: 60459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatttttattttttatt

SEQ ID NO: 60460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttatttttatttttt

SEQ ID NO: 60461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttatttttattttt

SEQ ID NO: 60462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttttatttttatttt

SEQ ID NO: 60463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttttttatttttattt

SEQ ID NO: 60464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttttttatttttatt

SEQ ID NO: 60465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttatttttttattttt

SEQ ID NO: 60466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttatttttttatttt

SEQ ID NO: 60467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttatttttttattt

SEQ ID NO: 60468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttattttttattttttt

SEQ ID NO: 60469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttattttttatttttt

SEQ ID NO: 60470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattttattttttattttt

SEQ ID NO: 60471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattttattttttatttt

SEQ ID NO: 60472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaattttattttttattt

SEQ ID NO: 60473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggttttttaattttattt

SEQ ID NO: 60474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagggttttttaattttatt

SEQ ID NO: 60475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagggttttttaattttat

SEQ ID NO: 60476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagggttttttaatttta

SEQ ID NO: 60477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtccatcttttgagggtt

SEQ ID NO: 60478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtccatcttttgagggt

SEQ ID NO: 60479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgtccatcttttgaggg

SEQ ID NO: 60480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtgtccatcttttgagg

SEQ ID NO: 60481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggtgtccatcttttgag

SEQ ID NO: 60482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttggtgtccatcttttga

SEQ ID NO: 60483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttggtgtccatcttttg

SEQ ID NO: 60484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttggtgtccatctttt

SEQ ID NO: 60485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttggtgtccatcttt

SEQ ID NO: 60486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttggtgtccatctt

SEQ ID NO: 60487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttggtgtccatct

SEQ ID NO: 60488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttggtgtccatc

SEQ ID NO: 60489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttggtgtccat

SEQ ID NO: 60490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttggtgtcca

SEQ ID NO: 60491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttttttttggtgtcc

SEQ ID NO: 60492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctttttttttttttttggt

SEQ ID NO: 60493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgatctaccttttttttt

SEQ ID NO: 60494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgatctacctttttttt

SEQ ID NO: 60495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgatctaccttttttt

SEQ ID NO: 60496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gataattttaaatgatctac

SEQ ID NO: 60497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actggataattttaaatgat

SEQ ID NO: 60498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cactgactggataattttaa

SEQ ID NO: 60499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctccactgactggataattt

SEQ ID NO: 60500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctccactgactggataatt

SEQ ID NO: 60501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctccactgactggataa

SEQ ID NO: 60502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgctccactgactggata

SEQ ID NO: 60503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttgctccactgactgga

SEQ ID NO: 60504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttgctccactgactgg

SEQ ID NO: 60505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttcttgctccactgac

SEQ ID NO: 60506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttcttgctccactga

SEQ ID NO: 60507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcttcttgctccactg

SEQ ID NO: 60508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttcttcttgctccact

SEQ ID NO: 60509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttcttcttgctccac

SEQ ID NO: 60510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatttcttcttgctcca

SEQ ID NO: 60511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttatttcttcttgctcc

SEQ ID NO: 60512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttatttcttcttgctc

SEQ ID NO: 60513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttatttcttcttgct

SEQ ID NO: 60514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttatttcttcttgc

SEQ ID NO: 60515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttttttttttatttcttc

SEQ ID NO: 60516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcatttttttttttattt

SEQ ID NO: 60517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactcatttttttttttatt

SEQ ID NO: 60518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatgtcccatgaaccttc

SEQ ID NO: 60519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgatgtcccatgaacctt

SEQ ID NO: 60520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacttaatgatgtcccatga

SEQ ID NO: 60521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccacttaatgatgtccca

SEQ ID NO: 60522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatgcatatattgttcca

SEQ ID NO: 60523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataatgcatatattgttcc

SEQ ID NO: 60524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatttcataatgcatatat

SEQ ID NO: 60525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgatttcataatgcatat

SEQ ID NO: 60526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgtgatttcataatgcat

SEQ ID NO: 60527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgtgatttcataatgca

SEQ ID NO: 60528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttctctgtgatttcataa

SEQ ID NO: 60529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcttctctgtgatttcat

SEQ ID NO: 60530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcttctctgtgatttca

SEQ ID NO: 60531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgtcttctctgtgatttc

SEQ ID NO: 60532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacccctttctgtcttctct

SEQ ID NO: 60533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacccctttctgtcttctc

SEQ ID NO: 60534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacacccctttctgtcttct

SEQ ID NO: 60535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacacccctttctgtcttc

SEQ ID NO: 60536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaatatttttacacccct

SEQ ID NO: 60537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaatatttttacacccc

SEQ ID NO: 60538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatttaaaaaatattttt

SEQ ID NO: 60539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcatttaaaaaatatttt

SEQ ID NO: 60540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtcatttaaaaaatattt

SEQ ID NO: 60541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacatattttagtcatttaa

SEQ ID NO: 60542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacatattttagtcattta

SEQ ID NO: 60543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaaatttgaacatatttt

SEQ ID NO: 60544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccccaaatttgaacatatt

SEQ ID NO: 60545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatctctccccaaatttga

SEQ ID NO: 60546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgttcatatctctcccca

SEQ ID NO: 60547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatgttcatatctctcccc

SEQ ID NO: 60548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttagatgttcatatctc

SEQ ID NO: 60549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaatttagatgttcatat

SEQ ID NO: 60550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgaatttagatgttcata

SEQ ID NO: 60551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttcctgaatttagatgt

SEQ ID NO: 60552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtttcctgaatttagatg

SEQ ID NO: 60553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagtttcctgaatttagat

SEQ ID NO: 60554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgagtttcctgaatttag

SEQ ID NO: 60555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattctttgagtttcctga

SEQ ID NO: 60556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggattctttgagtttcctg

SEQ ID NO: 60557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgggattctttgagtttc

SEQ ID NO: 60558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctatttgggattctttga

SEQ ID NO: 60559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcctatttgggattctttg

SEQ ID NO: 60560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttgtcctatttgggatt

SEQ ID NO: 60561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatttgtcctatttgggat

SEQ ID NO: 60562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagatttgtcctatttggga

SEQ ID NO: 60563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttagatttgtcctatttgg

SEQ ID NO: 60564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttagatttgtcctatttg

SEQ ID NO: 60565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggtgtgagccaccatgcc

SEQ ID NO: 60566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggtgtgagccac

SEQ ID NO: 60567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagtgctgggattacaggt

SEQ ID NO: 60568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcccctcaaagtgctggga

SEQ ID NO: 60569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgctcagcccctcaaagtg

SEQ ID NO: 60570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgatccactcccgctca

SEQ ID NO: 60571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcaggtgatccactccc

SEQ ID NO: 60572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcaggtgatccact

SEQ ID NO: 60573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcctgacctcaggtgat

SEQ ID NO: 60574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactcctgacctcaggtga

SEQ ID NO: 60575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttgaactcctgacctca

SEQ ID NO: 60576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaggctggtcttgaactc

SEQ ID NO: 60577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatgttggccaggctggtc

SEQ ID NO: 60578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatgttggccaggctggt

SEQ ID NO: 60579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccatgttggccaggctgg

SEQ ID NO: 60580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagagatgtggttttgcca

SEQ ID NO: 60581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtagagatgtggttttgcc

SEQ ID NO: 60582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtagagatgtggttttgc

SEQ ID NO: 60583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtagagatgtggttttg

SEQ ID NO: 60584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatttttggtagagatgtg

SEQ ID NO: 60585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatttttggtagagatgt

SEQ ID NO: 60586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaatttttggtagagatg

SEQ ID NO: 60587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaatttttggtagagat

SEQ ID NO: 60588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttttgtaatttttggtag

SEQ ID NO: 60589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggcacccaccaccacacc

SEQ ID NO: 60590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattataggcacccaccac

SEQ ID NO: 60591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgagtagctgggattatag

SEQ ID NO: 60592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcccgagtagctggga

SEQ ID NO: 60593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcccgagtagct

SEQ ID NO: 60594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctcagcctcccgagtag

SEQ ID NO: 60595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgcctcagcctcccgagt

SEQ ID NO: 60596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctgcctcagcctcccga

SEQ ID NO: 60597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcaattctctctgcctca

SEQ ID NO: 60598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtgggttcaagcaattctct

SEQ ID NO: 60599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacctcgtgggttcaagcaa

SEQ ID NO: 60600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacctcgtgggttcaagca

SEQ ID NO: 60601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacttccacctcgtgggtt

SEQ ID NO: 60602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaacttccacctcgtg

SEQ ID NO: 60603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcactgcaacttccacct

SEQ ID NO: 60604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcactgcaacttccacc

SEQ ID NO: 60605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtagcatgatctt

SEQ ID NO: 60606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcagtag

SEQ ID NO: 60607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accgtgttgcccaggctgga

SEQ ID NO: 60608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccgtgttgcccaggctgg

SEQ ID NO: 60609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgagatagagtttcaccgtg

SEQ ID NO: 60610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgagatagagtttcaccgt

SEQ ID NO: 60611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgagatagagtttcaccg

SEQ ID NO: 60612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccgagatagagtttcacc

SEQ ID NO: 60613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccgagatagagtttcac

SEQ ID NO: 60614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttccgagatagagtttca

SEQ ID NO: 60615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttccgagatagagtttc

SEQ ID NO: 60616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttccgagatagagttt

SEQ ID NO: 60617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttttccgagatagagt

SEQ ID NO: 60618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttttccgagatagag

SEQ ID NO: 60619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttttttttccgagataga

SEQ ID NO: 60620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttttttttccgagata

SEQ ID NO: 60621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcttttttttccgagat

SEQ ID NO: 60622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttcttttttttccgaga

SEQ ID NO: 60623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtggagactttctttctttt

SEQ ID NO: 60624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagtggagactttctttctt

SEQ ID NO: 60625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtctctagtggagactttc

SEQ ID NO: 60626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgatattatgtctctagtg

SEQ ID NO: 60627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgatattatgtctctagt

SEQ ID NO: 60628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatttgatgatattatgt

SEQ ID NO: 60629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaatttgatgatattatg

SEQ ID NO: 60630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcaatttgatgatattat

SEQ ID NO: 60631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggcaatttgatgatatta

SEQ ID NO: 60632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttggcaatttgatgat

SEQ ID NO: 60633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttttggcaatttgatga

SEQ ID NO: 60634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacttttggcaatttgatg

SEQ ID NO: 60635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctttcacttttggcaattt

SEQ ID NO: 60636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctttcacttttggcaatt

SEQ ID NO: 60637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacttccctttcacttttg

SEQ ID NO: 60638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaacttccctttcactttt

SEQ ID NO: 60639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaacttccctttcacttt

SEQ ID NO: 60640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttcaaacttccctttcac

SEQ ID NO: 60641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgctttcaaacttcccttt

SEQ ID NO: 60642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgctttcaaacttccctt

SEQ ID NO: 60643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctgctttcaaacttccc

SEQ ID NO: 60644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgctgctttcaaacttcc

SEQ ID NO: 60645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgctgctttcaaacttc

SEQ ID NO: 60646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgctgctttcaaactt

SEQ ID NO: 60647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttgctgctttcaaact

SEQ ID NO: 60648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttgctgctttcaaac

SEQ ID NO: 60649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttttttcttgctgcttt

SEQ ID NO: 60650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacatgacaattcagttttt

SEQ ID NO: 60651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacatgacaattcagtttt

SEQ ID NO: 60652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggacatgacaattcagttt

SEQ ID NO: 60653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggacatgacaattcagtt

SEQ ID NO: 60654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttggacatgacaattcag

SEQ ID NO: 60655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagagctcttttggacatg

SEQ ID NO: 60656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagagagctcttttggacat

SEQ ID NO: 60657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttaagagagctcttttg

SEQ ID NO: 60658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatcttaagagagctctt

SEQ ID NO: 60659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgttcatcttaagagagct

SEQ ID NO: 60660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaatctgctgttcatctt

SEQ ID NO: 60661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactgagaaatctgctgttc

SEQ ID NO: 60662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactgagaaatctgctgtt

SEQ ID NO: 60663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtttccactgagaaatct

SEQ ID NO: 60664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtttccactgagaaatc

SEQ ID NO: 60665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtttccactgagaaat

SEQ ID NO: 60666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaagtttccactgagaaa

SEQ ID NO: 60667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttaaagtttccactgaga

SEQ ID NO: 60668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcttttaaagtttccactg

SEQ ID NO: 60669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcttttaaagtttccact

SEQ ID NO: 60670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgctcttttaaagtttcc

SEQ ID NO: 60671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgctcttttaaagtttc

SEQ ID NO: 60672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttgctcttttaaagttt

SEQ ID NO: 60673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttatttgctcttttaaa

SEQ ID NO: 60674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactttatttgctcttttaa

SEQ ID NO: 60675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcactttatttgctctttta

SEQ ID NO: 60676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatatactttcactttat

SEQ ID NO: 60677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatatatactttcacttta

SEQ ID NO: 60678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatatatactttcacttt

SEQ ID NO: 60679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtattttgaatatatactt

SEQ ID NO: 60680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtattttgaatatatact

SEQ ID NO: 60681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagtattttgaatatatac

SEQ ID NO: 60682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaagtattttgaatatat

SEQ ID NO: 60683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaagtattttgaatata

SEQ ID NO: 60684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttaagtattttgaatat

SEQ ID NO: 60685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttaagtattttgaata

SEQ ID NO: 60686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttaagtattttgaat

SEQ ID NO: 60687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctttaagtattttgaa

SEQ ID NO: 60688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcagcagtttttttcttta

SEQ ID NO: 60689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtcagcagtttttttcttt

SEQ ID NO: 60690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggtcagcagtttttttct

SEQ ID NO: 60691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttggtcagcagtttttt

SEQ ID NO: 60692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggtatattattcttggtc

SEQ ID NO: 60693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaggtatattattcttggt

SEQ ID NO: 60694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaggtatattattcttgg

SEQ ID NO: 60695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaggtatattattcttg

SEQ ID NO: 60696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggacagtttttccaggta

SEQ ID NO: 60697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggacagtttttccaggt

SEQ ID NO: 60698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaggacagtttttccagg

SEQ ID NO: 60699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttaaaggacagtttttc

SEQ ID NO: 60700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattttaaaggacagttttt

SEQ ID NO: 60701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaattttaaaggacagtt

SEQ ID NO: 60702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttaattttaaaggacagt

SEQ ID NO: 60703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccttccttaattttaaagg

SEQ ID NO: 60704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccttccttaattttaaag

SEQ ID NO: 60705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccttccttaattttaaa

SEQ ID NO: 60706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatccttccttaattttaa

SEQ ID NO: 60707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgagaaagtttttatcct

SEQ ID NO: 60708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatgagaaagtttttatcc

SEQ ID NO: 60709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtatgagaaagttttta

SEQ ID NO: 60710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgtatgagaaagttttt

SEQ ID NO: 60711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcatttgcttgtatgagaa

SEQ ID NO: 60712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcagcatttgcttgtatg

SEQ ID NO: 60713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtggtgatgaactccctcag

SEQ ID NO: 60714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagataaatctagtggtga

SEQ ID NO: 60715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctataagataaatctagtgg

SEQ ID NO: 60716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctataagataaatctagtg

SEQ ID NO: 60717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatttcctataagataaat

SEQ ID NO: 60718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatttcctataagataaa

SEQ ID NO: 60719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcatttcctataagataa

SEQ ID NO: 60720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actttagcatttcctataag

SEQ ID NO: 60721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaactcactttagcattt

SEQ ID NO: 60722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaactcactttagcatt

SEQ ID NO: 60723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttgaagaactcacttta

SEQ ID NO: 60724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacttgaagaactcacttt

SEQ ID NO: 60725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtttcaacttgaagaactca

SEQ ID NO: 60726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtttcaacttgaagaactc

SEQ ID NO: 60727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcgtttcaacttgaagaact

SEQ ID NO: 60728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatgctttcgtttcaactt

SEQ ID NO: 60729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accatgctttcgtttcaact

SEQ ID NO: 60730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccatgctttcgtttcaac

SEQ ID NO: 60731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaccatgctttcgtttca

SEQ ID NO: 60732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctttaccatgctttcgtt

SEQ ID NO: 60733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttgctctttaccatgctt

SEQ ID NO: 60734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgttgctctttaccatgct

SEQ ID NO: 60735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtgttgctctttaccatg

SEQ ID NO: 60736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgctcttgtgttgctct

SEQ ID NO: 60737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgctcttgtgttgctc

SEQ ID NO: 60738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatatgctcttgtgttgct

SEQ ID NO: 60739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctttcatatgctcttgtg

SEQ ID NO: 60740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgctttcatatgctcttgt

SEQ ID NO: 60741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgagatttgtgctttcata

SEQ ID NO: 60742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagtgagatttgtgctttc

SEQ ID NO: 60743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actagtgagatttgtgcttt

SEQ ID NO: 60744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactagtgagatttgtgctt

SEQ ID NO: 60745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttactagtgagatttgt

SEQ ID NO: 60746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctttactagtgagatttg

SEQ ID NO: 60747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccatgtatttacctttact

SEQ ID NO: 60748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccatgtatttacctttac

SEQ ID NO: 60749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgtccatgtatttacctt

SEQ ID NO: 60750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttgtccatgtatttacc

SEQ ID NO: 60751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatttgtccatgtattta

SEQ ID NO: 60752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtattctctatttgtcca

SEQ ID NO: 60753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtattacagtattctcta

SEQ ID NO: 60754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagagtattacagtattct

SEQ ID NO: 60755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataatactattagagtatt

SEQ ID NO: 60756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataatactattagagtat

SEQ ID NO: 60757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaatgatttatataatact

SEQ ID NO: 60758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattataaatgatttatat

SEQ ID NO: 60759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattagaattataaatgatt

SEQ ID NO: 60760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattagaattataaatgat

SEQ ID NO: 60761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattagaattataaatga

SEQ ID NO: 60762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatattagaattataaatg

SEQ ID NO: 60763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttttatattagaattata

SEQ ID NO: 60764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttttatattagaattat

SEQ ID NO: 60765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatttaacttttatattag

SEQ ID NO: 60766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacatttaacttttatatta

SEQ ID NO: 60767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacatttaacttttatatt

SEQ ID NO: 60768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgacatttaacttttat

SEQ ID NO: 60769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattttgacatttaactt

SEQ ID NO: 60770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattattttgacatttaact

SEQ ID NO: 60771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaattattttgacatttaa

SEQ ID NO: 60772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttaattattttgacatt

SEQ ID NO: 60773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttattcttaattattttga

SEQ ID NO: 60774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttattcttaattattttg

SEQ ID NO: 60775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttattcttaattatttt

SEQ ID NO: 60776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattttagttattcttaat

SEQ ID NO: 60777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaattttagttattcttaa

SEQ ID NO: 60778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaattttagttattctta

SEQ ID NO: 60779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaattttagttattctt

SEQ ID NO: 60780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaacacatttttgtaattt

SEQ ID NO: 60781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaacacatttttgtaat

SEQ ID NO: 60782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacaaacacatttttgtaa

SEQ ID NO: 60783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgtgtttctacaaacac

SEQ ID NO: 60784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatgtgtttctacaaaca

SEQ ID NO: 60785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatgtgtttctacaaac

SEQ ID NO: 60786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataatgtgtttctacaaa

SEQ ID NO: 60787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttataatgtgtttctacaa

SEQ ID NO: 60788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctttttataatgtgttt

SEQ ID NO: 60789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatctttttataatgtgtt

SEQ ID NO: 60790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcacaatttacatctttt

SEQ ID NO: 60791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatgtcacaatttacatct

SEQ ID NO: 60792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatgtcacaatttacatc

SEQ ID NO: 60793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttatgtcacaatttacat

SEQ ID NO: 60794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttatgtcacaatttaca

SEQ ID NO: 60795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgttatgtcacaatttac

SEQ ID NO: 60796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acactttttgttatgtcaca

SEQ ID NO: 60797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcacactttttgttatgt

SEQ ID NO: 60798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacctccctcacacttttt

SEQ ID NO: 60799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatacctccctcacactttt

SEQ ID NO: 60800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatacctccctcacacttt

SEQ ID NO: 60801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaatacctccctcacactt

SEQ ID NO: 60802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttaatacctccctcac

SEQ ID NO: 60803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacttttaatacctccctca

SEQ ID NO: 60804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcatatatcaaaaatctt

SEQ ID NO: 60805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatcatatatcaaaaatct

SEQ ID NO: 60806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttcaatcatatatcaaaa

SEQ ID NO: 60807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacttcaatcatatatcaaa

SEQ ID NO: 60808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataacaacttaacttcaatc

SEQ ID NO: 60809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctgataacaacttaactt

SEQ ID NO: 60810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctgataacaacttaact

SEQ ID NO: 60811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagctgataacaacttaac

SEQ ID NO: 60812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttaagctgataacaactt

SEQ ID NO: 60813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatagtctactttaagctg

SEQ ID NO: 60814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatagtctactttaagct

SEQ ID NO: 60815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatgaggcaatcacaaata

SEQ ID NO: 60816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttatcatgaggcaatca

SEQ ID NO: 60817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtggttatcatgaggcaatc

SEQ ID NO: 60818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtggttatcatgaggca

SEQ ID NO: 60819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgtggttatcatgaggc

SEQ ID NO: 60820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttgtggttatcatgagg

SEQ ID NO: 60821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgtggattttccttgtggtt

SEQ ID NO: 60822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgtggattttccttgtggt

SEQ ID NO: 60823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacgtggattttccttgtgg

SEQ ID NO: 60824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacgtggattttccttgtg

SEQ ID NO: 60825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttacgtggattttcc

SEQ ID NO: 60826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatttttacgtggatttt

SEQ ID NO: 60827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtatttttacgtggattt

SEQ ID NO: 60828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgtatttttacgtgga

SEQ ID NO: 60829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctgtatttttacgtgg

SEQ ID NO: 60830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttctgtatttttacgtg

SEQ ID NO: 60831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttctgtatttttacgt

SEQ ID NO: 60832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttctgtatttttacg

SEQ ID NO: 60833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttatttctgtatttttac

SEQ ID NO: 60834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttatttctgtattttt

SEQ ID NO: 60835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttttatttctgtattt

SEQ ID NO: 60836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttttttatttctgtatt

SEQ ID NO: 60837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatttctcttttttatttc

SEQ ID NO: 60838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatatgctatgatttctct

SEQ ID NO: 60839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgatatgctatgatttc

SEQ ID NO: 60840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtgatatgctatgattt

SEQ ID NO: 60841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtgatatgctatgatt

SEQ ID NO: 60842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgatattttattgtgata

SEQ ID NO: 60843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgattggatgatattttatt

SEQ ID NO: 60844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgattggatgatattttat

SEQ ID NO: 60845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgattggatgatatttta

SEQ ID NO: 60846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgattggatgatatttt

SEQ ID NO: 60847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgtgattggatgatatt

SEQ ID NO: 60848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgtgattggatgatat

SEQ ID NO: 60849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttcttttgtgattggatg

SEQ ID NO: 60850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgtcttcttttgtgattg

SEQ ID NO: 60851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactgtcttcttttgtgatt

SEQ ID NO: 60852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaactgtcttcttttgtga

SEQ ID NO: 60853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttaactgtcttcttttgt

SEQ ID NO: 60854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttaactgtcttctttt

SEQ ID NO: 60855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctcttaactgtcttcttt

SEQ ID NO: 60856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctcttaactgtcttctt

SEQ ID NO: 60857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctcttaactgtcttct

SEQ ID NO: 60858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctctcttaactgtcttc

SEQ ID NO: 60859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttttctctcttaactgt

SEQ ID NO: 60860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtctttttctctcttaact

SEQ ID NO: 60861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtctttttctctcttaac

SEQ ID NO: 60862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtctttttctctcttaa

SEQ ID NO: 60863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgtctttttctctctta

SEQ ID NO: 60864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgtctttttctctctt

SEQ ID NO: 60865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctgtctttttctctct

SEQ ID NO: 60866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttctgtctttttctctc

SEQ ID NO: 60867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttctgtctttttctc

SEQ ID NO: 60868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattctttttttctgtctt

SEQ ID NO: 60869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaattctttttttctgtct

SEQ ID NO: 60870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaattctttttttctgtc

SEQ ID NO: 60871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttgtaattctttttttct

SEQ ID NO: 60872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttgtaattcttttttt

SEQ ID NO: 60873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttttgtaattctttttt

SEQ ID NO: 60874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgttttgtaattcttttt

SEQ ID NO: 60875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgttttgtaattctttt

SEQ ID NO: 60876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttttctgttttgtaatt

SEQ ID NO: 60877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaatttttctgttttgta

SEQ ID NO: 60878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaatttttctgttttgt

SEQ ID NO: 60879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaatttttctgttttg

SEQ ID NO: 60880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttaaatttttctgtttt

SEQ ID NO: 60881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgttaaatttttctgttt

SEQ ID NO: 60882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctttttgttaaatttttct

SEQ ID NO: 60883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcctttttgttaaatttt

SEQ ID NO: 60884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattgcctttttgttaaat

SEQ ID NO: 60885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actattgcctttttgttaaa

SEQ ID NO: 60886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaggtaatgacttactatt

SEQ ID NO: 60887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataatcattggtaggtaa

SEQ ID NO: 60888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaataatcattggtaggta

SEQ ID NO: 60889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttgaaataatcattggt

SEQ ID NO: 60890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttgaaataatcattgg

SEQ ID NO: 60891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccatttgtatttgaaata

SEQ ID NO: 60892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatccatttgtatttgaaat

SEQ ID NO: 60893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaagtttaatccatttgta

SEQ ID NO: 60894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgggaagtttaatccatt

SEQ ID NO: 60895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattgggaagtttaatccat

SEQ ID NO: 60896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgattgggaagtttaatcca

SEQ ID NO: 60897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgattgggaagtttaatcc

SEQ ID NO: 60898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggtcttttgattgggaag

SEQ ID NO: 60899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcagccattgtaggtcttt

SEQ ID NO: 60900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaatctatgcagccattg

SEQ ID NO: 60901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataaatctatgcagccatt

SEQ ID NO: 60902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataaatctatgcagccat

SEQ ID NO: 60903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcataaatctatgcagc

SEQ ID NO: 60904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttcataaatctatgcag

SEQ ID NO: 60905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcttgttttcataaatct

SEQ ID NO: 60906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagacagcatataactggat

SEQ ID NO: 60907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaacgagtatctggagacag

SEQ ID NO: 60908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctgaaacgagtatctgg

SEQ ID NO: 60909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatctgaaacgagtatctg

SEQ ID NO: 60910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaatctgaaacgagtatc

SEQ ID NO: 60911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaatctgaaacgagtat

SEQ ID NO: 60912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaaatctgaaacgagta

SEQ ID NO: 60913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttttcttaaatctgaaac

SEQ ID NO: 60914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactatgttttcttaaatc

SEQ ID NO: 60915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaactatgttttcttaaat

SEQ ID NO: 60916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaactatgttttcttaaa

SEQ ID NO: 60917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actttcaaactatgttttct

SEQ ID NO: 60918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaattaactttcaaactat

SEQ ID NO: 60919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaattaactttcaaacta

SEQ ID NO: 60920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaattaactttcaaact

SEQ ID NO: 60921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcaattaactttcaaac

SEQ ID NO: 60922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatcaattaactttcaaa

SEQ ID NO: 60923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttatcaattaactttcaa

SEQ ID NO: 60924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaatgtatcttttttatc

SEQ ID NO: 60925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaaatgtatctttttta

SEQ ID NO: 60926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacaaaatgtatctttttt

SEQ ID NO: 60927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatttctacaaaatgtatc

SEQ ID NO: 60928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaccatttctacaaaatg

SEQ ID NO: 60929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttaccatttctacaaaat

SEQ ID NO: 60930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttaccatttctacaaaa

SEQ ID NO: 60931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggttaccatttctacaaa

SEQ ID NO: 60932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttggttaccatttctaca

SEQ ID NO: 60933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttttggttaccatttcta

SEQ ID NO: 60934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctcttttggttaccattt

SEQ ID NO: 60935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatagccccattgctctctt

SEQ ID NO: 60936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaggacgactgtatagcccc

SEQ ID NO: 60937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagatactgaaggacgactg

SEQ ID NO: 60938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaccatgaccctgtagata

SEQ ID NO: 60939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaaccatgaccctgtaga

SEQ ID NO: 60940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggttctgaaaccatgaccc

SEQ ID NO: 60941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggggttctgaaaccatgacc

SEQ ID NO: 60942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatcccttggggttctgaa

SEQ ID NO: 60943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtatcccttggggttctga

SEQ ID NO: 60944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtatcccttggggttctg

SEQ ID NO: 60945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattttggtatcccttgggg

SEQ ID NO: 60946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcatcctcaattttggtat

SEQ ID NO: 60947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagcatcctcaattttggta

SEQ ID NO: 60948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgggacttaagcatcctcaa

SEQ ID NO: 60949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgtgggacttaagcatcc

SEQ ID NO: 60950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagactgactgtgggactt

SEQ ID NO: 60951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccacaggtcctgcaagact

SEQ ID NO: 60952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccacaggtcctgcaagac

SEQ ID NO: 60953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccacaggtcctgcaaga

SEQ ID NO: 60954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatccacaggtcctgcaag

SEQ ID NO: 60955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatccacaggtcctgcaa

SEQ ID NO: 60956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatccacaggtcctgca

SEQ ID NO: 60957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggaatgtgaaatccacag

SEQ ID NO: 60958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattcatggaatgtgaaatc

SEQ ID NO: 60959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaacactgtattcatggaa

SEQ ID NO: 60960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgaaaacactgtattcat

SEQ ID NO: 60961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agccaatgctgattgaaaac

SEQ ID NO: 60962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagattcagccaatgctgat

SEQ ID NO: 60963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctgtagattcagccaat

SEQ ID NO: 60964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatctgtagattcagccaa

SEQ ID NO: 60965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatctgtagattcagcca

SEQ ID NO: 60966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgggttttacatctgtagat

SEQ ID NO: 60967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtctgtgggttttacatct

SEQ ID NO: 60968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgtctgtgggttttacat

SEQ ID NO: 60969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagggtgtcctctgtgtctg

SEQ ID NO: 60970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atataattacagggtgtcct

SEQ ID NO: 60971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctgatataattacagggtg

SEQ ID NO: 60972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctgatataattacagggt

SEQ ID NO: 60973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctgatataattacaggg

SEQ ID NO: 60974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttggctgatataattaca

SEQ ID NO: 60975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatctattttggctgatat

SEQ ID NO: 60976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatctattttggctgata

SEQ ID NO: 60977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaaatctattttggctg

SEQ ID NO: 60978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaaaatctattttggct

SEQ ID NO: 60979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttaaaatctattttggc

SEQ ID NO: 60980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttaaaatctattttgg

SEQ ID NO: 60981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttaaaatctattttg

SEQ ID NO: 60982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacagttttttatttaaaa

SEQ ID NO: 60983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgacagttttttatttaaa

SEQ ID NO: 60984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtgacagttttttattta

SEQ ID NO: 60985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcttgtgacagtttttta

SEQ ID NO: 60986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctcttgtgacagtttttt

SEQ ID NO: 60987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctcttgtgacagttttt

SEQ ID NO: 60988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttgtctcttgtgacagtt

SEQ ID NO: 60989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacctactttgtctcttgt

SEQ ID NO: 60990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgacctactttgtctcttg

SEQ ID NO: 60991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgacctactttgtctctt

SEQ ID NO: 60992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatgacctactttgtct

SEQ ID NO: 60993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttatgacctactttgtc

SEQ ID NO: 60994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttattttatgacctactt

SEQ ID NO: 60995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttattttatgacctact

SEQ ID NO: 60996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcttattttatgacctac

SEQ ID NO: 60997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatcttattttatgaccta

SEQ ID NO: 60998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatcttattttatgacc

SEQ ID NO: 60999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcttttatcttattttat

SEQ ID NO: 61000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaattaactcttttatct

SEQ ID NO: 61001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgaattaactcttttatc

SEQ ID NO: 61002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgatgaattaactctttta

SEQ ID NO: 61003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgatgaattaactctttt

SEQ ID NO: 61004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcttcttgatgaattaac

SEQ ID NO: 61005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatatcttcttgatgaatt

SEQ ID NO: 61006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattgttatatcttcttga

SEQ ID NO: 61007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattgttatatcttcttg

SEQ ID NO: 61008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatatatttataattgtta

SEQ ID NO: 61009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgatggattcacatatatt

SEQ ID NO: 61010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgatggattcacatatat

SEQ ID NO: 61011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatgatggattcacatata

SEQ ID NO: 61012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgctttgatgatggattc

SEQ ID NO: 61013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgctttgatgatggatt

SEQ ID NO: 61014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgtatttacatgctttgatg

SEQ ID NO: 61015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgtatttacatgctttgat

SEQ ID NO: 61016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacgtatttacatgctttga

SEQ ID NO: 61017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttacgtatttacatgctt

SEQ ID NO: 61018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaatgattgctttacgtat

SEQ ID NO: 61019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatctgtcaatgattgctt

SEQ ID NO: 61020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagatctgtcaatgattgct

SEQ ID NO: 61021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccttcagatctgtcaatg

SEQ ID NO: 61022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcccttcagatctgtcaat

SEQ ID NO: 61023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgtttatcccttcagatc

SEQ ID NO: 61024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcatgtttatcccttcag

SEQ ID NO: 61025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtgttgctgcatgtttat

SEQ ID NO: 61026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatggtgttgctgcatgtt

SEQ ID NO: 61027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgttatggtgttgctgcat

SEQ ID NO: 61028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtatcctactgttatggt

SEQ ID NO: 61029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagtcgggtattgatgtat

SEQ ID NO: 61030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcaagtcgggtattgatg

SEQ ID NO: 61031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attattgcaagtcgggtatt

SEQ ID NO: 61032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcattattgcaagtcgggt

SEQ ID NO: 61033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcattattgcaagtcgg

SEQ ID NO: 61034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgttcattattgcaagt

SEQ ID NO: 61035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgttctgttcattattgc

SEQ ID NO: 61036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatctggctgttctgttc

SEQ ID NO: 61037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagattccatatctggctgt

SEQ ID NO: 61038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagattccatatctggctg

SEQ ID NO: 61039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatagattccatatctgg

SEQ ID NO: 61040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttatagattccatatctg

SEQ ID NO: 61041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatccacagtttgtttata

SEQ ID NO: 61042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaaatccacagtttgttt

SEQ ID NO: 61043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcgttgttcaaatccaca

SEQ ID NO: 61044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtctatagcgttgttcaaat

SEQ ID NO: 61045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtctatagcgttgttcaaa

SEQ ID NO: 61046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatccatttggtctatagc

SEQ ID NO: 61047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatccatttggtctatag

SEQ ID NO: 61048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtttgtgatccatttgg

SEQ ID NO: 61049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgtgtttgtgatccattt

SEQ ID NO: 61050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtagcatattctgtgtgtt

SEQ ID NO: 61051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgggtagcatattctgtgt

SEQ ID NO: 61052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatgctgttgggtagcata

SEQ ID NO: 61053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagatggtatattaagat

SEQ ID NO: 61054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaagatggtatattaaga

SEQ ID NO: 61055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcgcacttgaaaagatggt

SEQ ID NO: 61056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgcgcacttgaaaagatg

SEQ ID NO: 61057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatattctgtgcgcactt

SEQ ID NO: 61058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcctgagaatattctgtgcg

SEQ ID NO: 61059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatgtgatctatcctgaga

SEQ ID NO: 61060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgacctgatatgtgatcta

SEQ ID NO: 61061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgacctgatatgtgatct

SEQ ID NO: 61062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaaacaaacttcatgacc

SEQ ID NO: 61063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagttgtcaaaacaaactt

SEQ ID NO: 61064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacagttgtcaaaacaaact

SEQ ID NO: 61065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaacagttgtcaaaacaaa

SEQ ID NO: 61066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaacagttgtcaaaacaa

SEQ ID NO: 61067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttcttaacagttgtcaa

SEQ ID NO: 61068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacttcttaacagttgtca

SEQ ID NO: 61069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtatgatttcaacttcttaa

SEQ ID NO: 61070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtcataaaagatatctgg

SEQ ID NO: 61071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgtggtcataaaagata

SEQ ID NO: 61072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccattgtggtcataaaagat

SEQ ID NO: 61073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccattgtggtcataaaa

SEQ ID NO: 61074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttccattgtggtcataaa

SEQ ID NO: 61075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtttccttccattgtggt

SEQ ID NO: 61076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagtttccttccattgtgg

SEQ ID NO: 61077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttccagtttccttccatt

SEQ ID NO: 61078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgacttccagtttccttcc

SEQ ID NO: 61079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactgacttccagtttcct

SEQ ID NO: 61080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattactgacttccagtttc

SEQ ID NO: 61081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctattactgacttccagttt

SEQ ID NO: 61082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctattactgacttccag

SEQ ID NO: 61083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctattactgacttcca

SEQ ID NO: 61084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttctattactgacttcc

SEQ ID NO: 61085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttttccttctattactga

SEQ ID NO: 61086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttttccttctattactg

SEQ ID NO: 61087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttttccttctattact

SEQ ID NO: 61088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagttttccttctattac

SEQ ID NO: 61089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatttttcagttttcctt

SEQ ID NO: 61090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaatttttcagttttcct

SEQ ID NO: 61091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacatatttgtgaatttttc

SEQ ID NO: 61092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacatatttgtgaattttt

SEQ ID NO: 61093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttccacatatttgtgaat

SEQ ID NO: 61094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttccacatatttgtgaa

SEQ ID NO: 61095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaatttccacatatttgt

SEQ ID NO: 61096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagagagtgttgtttaattt

SEQ ID NO: 61097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagagagtgttgtttaatt

SEQ ID NO: 61098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagagagtgttgtttaat

SEQ ID NO: 61099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaagagagtgttgtttaa

SEQ ID NO: 61100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcaagagagtgttgttta

SEQ ID NO: 61101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttttcaagagagtgttgt

SEQ ID NO: 61102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acccattgctttttcaagag

SEQ ID NO: 61103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacccattgctttttcaaga

SEQ ID NO: 61104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacccattgctttttcaag

SEQ ID NO: 61105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgacccattgctttttca

SEQ ID NO: 61106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgacccattgctttttc

SEQ ID NO: 61107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttgacccattgcttttt

SEQ ID NO: 61108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttgacccattgctttt

SEQ ID NO: 61109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttgacccattgcttt

SEQ ID NO: 61110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctttgacccattgctt

SEQ ID NO: 61111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctttgacccattgct

SEQ ID NO: 61112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttttttctttgacccat

SEQ ID NO: 61113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgattttttttctttgacc

SEQ ID NO: 61114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattgattttttttctttg

SEQ ID NO: 61115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctattgattttttttcttt

SEQ ID NO: 61116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctattgattttttttctt

SEQ ID NO: 61117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttcctattgatttttt

SEQ ID NO: 61118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattttcctattgattttt

SEQ ID NO: 61119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattttcctattgatttt

SEQ ID NO: 61120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaattttcctattgattt

SEQ ID NO: 61121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatacttttaaattttcc

SEQ ID NO: 61122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagatacttttaaattttc

SEQ ID NO: 61123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaagatacttttaaatt

SEQ ID NO: 61124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcaagatacttttaaat

SEQ ID NO: 61125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttcaagatactttta

SEQ ID NO: 61126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttcaagatactttt

SEQ ID NO: 61127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttgtttcaagatacttt

SEQ ID NO: 61128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttgtttcaagatactt

SEQ ID NO: 61129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttgtttgtttcaagat

SEQ ID NO: 61130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttttgtttgtttcaaga

SEQ ID NO: 61131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttttgtttgtttcaag

SEQ ID NO: 61132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctttcatttttgtttgtt

SEQ ID NO: 61133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaattgtgctttcattttt

SEQ ID NO: 61134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaattgtgctttcatttt

SEQ ID NO: 61135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaattgtgctttcattt

SEQ ID NO: 61136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaattttggaaattgtgc

SEQ ID NO: 61137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catctcataaattttggaaa

SEQ ID NO: 61138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcatctcataaattttgg

SEQ ID NO: 61139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgcatctcataaattttg

SEQ ID NO: 61140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgcatctcataaatttt

SEQ ID NO: 61141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctgcatctcataaattt

SEQ ID NO: 61142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttgctgcatctcataaa

SEQ ID NO: 61143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcttttgctgcatctcat

SEQ ID NO: 61144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactgcttttgctgcatct

SEQ ID NO: 61145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactgcttttgctgcatc

SEQ ID NO: 61146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattactgcttttgctgcat

SEQ ID NO: 61147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattactgcttttgctgca

SEQ ID NO: 61148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttattactgcttttgct

SEQ ID NO: 61149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttattactgcttttgc

SEQ ID NO: 61150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aataagatttgcttttatta

SEQ ID NO: 61151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgtagacatgtatctca

SEQ ID NO: 61152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatgtagacatgtatctc

SEQ ID NO: 61153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatgtagacatgtatct

SEQ ID NO: 61154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataatgtagacatgtatc

SEQ ID NO: 61155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttataatgtagacatgtat

SEQ ID NO: 61156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttataatgtagacatgt

SEQ ID NO: 61157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttataatgtagacatg

SEQ ID NO: 61158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgagatatttctttttat

SEQ ID NO: 61159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgagatatttcttttta

SEQ ID NO: 61160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatatgagatatttcttt

SEQ ID NO: 61161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattgtttatatgagatatt

SEQ ID NO: 61162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacatgtaaatctatattgt

SEQ ID NO: 61163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagacatgtaaatctatat

SEQ ID NO: 61164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttcctagacatgtaaatct

SEQ ID NO: 61165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagttcctagacatgtaaat

SEQ ID NO: 61166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagttcctagacatgtaaa

SEQ ID NO: 61167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctagttcctagacatgtaa

SEQ ID NO: 61168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctagttcctagacatgta

SEQ ID NO: 61169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctagttcctagacatgt

SEQ ID NO: 61170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttctagttcctagacat

SEQ ID NO: 61171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttttctagttcctaga

SEQ ID NO: 61172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttttctagttcctag

SEQ ID NO: 61173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttgttctttttctagttc

SEQ ID NO: 61174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttgttctttttctagtt

SEQ ID NO: 61175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcttagtttgttctttttc

SEQ ID NO: 61176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgttgggcttagtttgttc

SEQ ID NO: 61177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgatgttgggcttagtttg

SEQ ID NO: 61178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgatgttgggcttagttt

SEQ ID NO: 61179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgatgttgggcttagtt

SEQ ID NO: 61180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctgatgttgggcttagt

SEQ ID NO: 61181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttgctgatgttgggctt

SEQ ID NO: 61182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttttgctgatgttgggct

SEQ ID NO: 61183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccttttgctgatgttgg

SEQ ID NO: 61184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttccttttgctgatgttg

SEQ ID NO: 61185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccttccttttgctgatg

SEQ ID NO: 61186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttccttccttttgctg

SEQ ID NO: 61187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatttccttccttttgct

SEQ ID NO: 61188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atacttattatttccttcct

SEQ ID NO: 61189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatacttattatttccttc

SEQ ID NO: 61190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctctaatacttattatttc

SEQ ID NO: 61191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agctctaatacttattattt

SEQ ID NO: 61192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttagctctaatacttatta

SEQ ID NO: 61193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttagctctaatacttatt

SEQ ID NO: 61194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttacttagctctaatact

SEQ ID NO: 61195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttacttagctctaatac

SEQ ID NO: 61196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcacttacttagctctaa

SEQ ID NO: 61197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttcacttacttagctct

SEQ ID NO: 61198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatttcacttacttagct

SEQ ID NO: 61199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctctatttcacttactta

SEQ ID NO: 61200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctctatttcacttactt

SEQ ID NO: 61201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattctctatttcacttact

SEQ ID NO: 61202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattctctatttcacttac

SEQ ID NO: 61203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattctctatttcactta

SEQ ID NO: 61204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttattctctatttcactt

SEQ ID NO: 61205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttttattctctatttca

SEQ ID NO: 61206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcttttttattctctatt

SEQ ID NO: 61207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgcttttttattctcta

SEQ ID NO: 61208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattgcttttttattctct

SEQ ID NO: 61209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattgcttttttattctc

SEQ ID NO: 61210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctattgcttttttattct

SEQ ID NO: 61211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctattgcttttttattc

SEQ ID NO: 61212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttctattgctttttt

SEQ ID NO: 61213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgactttttctattgcttt

SEQ ID NO: 61214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgactttttctattgctt

SEQ ID NO: 61215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgactttttctattgct

SEQ ID NO: 61216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttttgttgactttttctat

SEQ ID NO: 61217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttttgttgactttttcta

SEQ ID NO: 61218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagttttgttgactttttc

SEQ ID NO: 61219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gaaaaaaccaattcttagtt

SEQ ID NO: 61220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgaaaaaaccaattcttagt

SEQ ID NO: 61221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcgaaaaaaccaattcttag

SEQ ID NO: 61222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttcgaaaaaaccaattc

SEQ ID NO: 61223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttcgaaaaaaccaatt

SEQ ID NO: 61224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctttcgaaaaaaccaat

SEQ ID NO: 61225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatctttcgaaaaaacc

SEQ ID NO: 61226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctattttatctttcgaaaa

SEQ ID NO: 61227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctattttatctttcgaaa

SEQ ID NO: 61228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggatttgtctattttatct

SEQ ID NO: 61229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaggatttgtctatttta

SEQ ID NO: 61230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctaaggatttgtctatttt

SEQ ID NO: 61231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcttgctaaggatttgtct

SEQ ID NO: 61232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatgcttgctaaggattt

SEQ ID NO: 61233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttatgcttgctaaggatt

SEQ ID NO: 61234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagttatgcttgctaagga

SEQ ID NO: 61235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagttatgcttgctaagg

SEQ ID NO: 61236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttagttatgcttgctaag

SEQ ID NO: 61237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttagttatgcttgctaa

SEQ ID NO: 61238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttagttatgcttgcta

SEQ ID NO: 61239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcttagttatgcttgct

SEQ ID NO: 61240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttttttcttagttatgct

SEQ ID NO: 61241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatcttttttcttagttatg

SEQ ID NO: 61242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcctctatcttttttctt

SEQ ID NO: 61243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtcctctatcttttttct

SEQ ID NO: 61244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatttgagtcctctatct

SEQ ID NO: 61245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatatttgagtcctctatc

SEQ ID NO: 61246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatatttgagtcctctat

SEQ ID NO: 61247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttacatatttgagtcct

SEQ ID NO: 61248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggttttacatatttgagtc

SEQ ID NO: 61249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggttttacatatttgagt

SEQ ID NO: 61250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttctggttttacatattt

SEQ ID NO: 61251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttctggttttacatatt

SEQ ID NO: 61252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttctggttttacatat

SEQ ID NO: 61253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcatttctggttttacat

SEQ ID NO: 61254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctttcatttctggtttta

SEQ ID NO: 61255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctctttcatttctggttt

SEQ ID NO: 61256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaattctcctctttcattt

SEQ ID NO: 61257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccataaaatcagttgtaaat

SEQ ID NO: 61258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcccataaaatcagttgta

SEQ ID NO: 61259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcccataaaatcagttgt

SEQ ID NO: 61260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattcccataaaatcagtt

SEQ ID NO: 61261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttattcccataaaatcagt

SEQ ID NO: 61262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atccttcttattcccataaa

SEQ ID NO: 61263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatccttcttattcccataa

SEQ ID NO: 61264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatccttcttattcccata

SEQ ID NO: 61265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgatccttcttattccca

SEQ ID NO: 61266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggtagtctctttgatcct

SEQ ID NO: 61267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatggtagtctctttgat

SEQ ID NO: 61268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtataattgttcatggta

SEQ ID NO: 61269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggtgtataattgttcatg

SEQ ID NO: 61270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttggtgtataattgttcat

SEQ ID NO: 61271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaatttgttggtgtataa

SEQ ID NO: 61272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttatccaatttgttggtg

SEQ ID NO: 61273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagttatccaatttgttgg

SEQ ID NO: 61274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaagttatccaatttgttg

SEQ ID NO: 61275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctaagttatccaatttg

SEQ ID NO: 61276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttccttctaagttatccaat

SEQ ID NO: 61277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctattccttctaagttatc

SEQ ID NO: 61278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctattccttctaagttat

SEQ ID NO: 61279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatttacctattccttcta

SEQ ID NO: 61280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatttacctattccttct

SEQ ID NO: 61281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaatttacctattccttc

SEQ ID NO: 61282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggaatttacctattcctt

SEQ ID NO: 61283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatttttggaatttacct

SEQ ID NO: 61284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaggttgtatatttttgga

SEQ ID NO: 61285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaggttgtatatttttgg

SEQ ID NO: 61286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcttggtaggttgtatat

SEQ ID NO: 61287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgattcagtcttggtaggt

SEQ ID NO: 61288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcatgattcagtcttggta

SEQ ID NO: 61289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcatgattcagtcttggt

SEQ ID NO: 61290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcctcatgattcagtctt

SEQ ID NO: 61291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttcctcatgattcagtc

SEQ ID NO: 61292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctatttcctcatgattca

SEQ ID NO: 61293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttattctatttcctcatg

SEQ ID NO: 61294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagttattctatttcctc

SEQ ID NO: 61295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctattcagttattctattt

SEQ ID NO: 61296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctattcagttattctatt

SEQ ID NO: 61297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttgtctattcagttatt

SEQ ID NO: 61298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttcaatttgtctattcagt

SEQ ID NO: 61299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggttcaatttgtctattc

SEQ ID NO: 61300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattggttcaatttgtcta

SEQ ID NO: 61301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattggttcaatttgt

SEQ ID NO: 61302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattggttcaatt

SEQ ID NO: 61303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattggttca

SEQ ID NO: 61304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattggt

SEQ ID NO: 61305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 61306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 61307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 61308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 61309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 61310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattattattattattatt

SEQ ID NO: 61311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcattatcattattattatt

SEQ ID NO: 61312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatcattatcattattatt

SEQ ID NO: 61313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagttactatcattatcat

SEQ ID NO: 61314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggagttactatcattatca

SEQ ID NO: 61315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggagttactatcattatc

SEQ ID NO: 61316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgggagttactatcattat

SEQ ID NO: 61317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgggagttactatcatta

SEQ ID NO: 61318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttgggagttactatcatt

SEQ ID NO: 61319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttgggagttactatca

SEQ ID NO: 61320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttgggagttactatc

SEQ ID NO: 61321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacatttcttttttgggagt

SEQ ID NO: 61322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcctgtacatttctttttt

SEQ ID NO: 61323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagagaagccgtctggtcct

SEQ ID NO: 61324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagagaagccgtctggtc

SEQ ID NO: 61325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccagagaagccgtctggt

SEQ ID NO: 61326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacttctccagagaagccgt

SEQ ID NO: 61327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttggacttctccagagaag

SEQ ID NO: 61328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttggacttctccagagaa

SEQ ID NO: 61329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtttggttggacttctc

SEQ ID NO: 61330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtttggttggacttct

SEQ ID NO: 61331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatgtttggttggacttc

SEQ ID NO: 61332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaatgtttggttggact

SEQ ID NO: 61333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttaaatgtttggttggac

SEQ ID NO: 61334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctttaaatgtttggttgg

SEQ ID NO: 61335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctttaaatgtttggttg

SEQ ID NO: 61336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcttctttaaatgtttgg

SEQ ID NO: 61337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttgtttcttctttaaat

SEQ ID NO: 61338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagaattaatgttgtttc

SEQ ID NO: 61339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagaattaatgttgttt

SEQ ID NO: 61340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagagtttgagaagaatta

SEQ ID NO: 61341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagagtttgagaagaatt

SEQ ID NO: 61342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagagagtttgagaagaat

SEQ ID NO: 61343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagttttaagagagtttga

SEQ ID NO: 61344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagttttaagagagtttg

SEQ ID NO: 61345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcaaagttttaagagagtt

SEQ ID NO: 61346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttcaaagttttaagaga

SEQ ID NO: 61347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcttcaaagttttaagag

SEQ ID NO: 61348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctcttcaaagttttaaga

SEQ ID NO: 61349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcctcttcaaagttttaa

SEQ ID NO: 61350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gaagtgttctttcctcttca

SEQ ID NO: 61351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgaagtgttctttcctcttc

SEQ ID NO: 61352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcgaagtgttctttcctctt

SEQ ID NO: 61353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccccataaaatgactttcg

SEQ ID NO: 61354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggccccataaaatgacttt

SEQ ID NO: 61355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatgagaataattctggcc

SEQ ID NO: 61356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatgagaataattctggc

SEQ ID NO: 61357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatatgagaataattctgg

SEQ ID NO: 61358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctttgatatgagaataatt

SEQ ID NO: 61359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctggctttgatatgagaat

SEQ ID NO: 61360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctggctttgatatgagaa

SEQ ID NO: 61361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctggctttgatatgaga

SEQ ID NO: 61362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtgtctttgtctggcttt

SEQ ID NO: 61363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acagtgtctttgtctggctt

SEQ ID NO: 61364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacagtgtctttgtctggc

SEQ ID NO: 61365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacagtgtctttgtctgg

SEQ ID NO: 61366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttacagtgtctttgtctg

SEQ ID NO: 61367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttacagtgtctttgtct

SEQ ID NO: 61368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcttacagtgtctttgt

SEQ ID NO: 61369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttcttacagtgtctttg

SEQ ID NO: 61370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttcttacagtgtcttt

SEQ ID NO: 61371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taattttcttttcttacagt

SEQ ID NO: 61372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaagctgtaattttctttt

SEQ ID NO: 61373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaagctgtaattttcttt

SEQ ID NO: 61374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcaaaagctgtaattttc

SEQ ID NO: 61375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcaaaagctgtaatttt

SEQ ID NO: 61376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtcacttccttcaaaagc

SEQ ID NO: 61377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaagtcacttccttcaaa

SEQ ID NO: 61378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacaatgttgctgaagtcac

SEQ ID NO: 61379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttccacaatgttgctgaagt

SEQ ID NO: 61380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctattccacaatgttgctga

SEQ ID NO: 61381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtacgtccatgagagaaaaa

SEQ ID NO: 61382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtacgtccatgagagaaaa

SEQ ID NO: 61383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttggtacgtccatgagaga

SEQ ID NO: 61384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttggtacgtccatgagag

SEQ ID NO: 61385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atccatgtgtatgtagatgt

SEQ ID NO: 61386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagagaactgatccatgtgt

SEQ ID NO: 61387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggagagaactgatccatgt

SEQ ID NO: 61388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggagagaactgatccat

SEQ ID NO: 61389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctggagagaactgatcca

SEQ ID NO: 61390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtttctctggagagaactg

SEQ ID NO: 61391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggtttctctggagagaac

SEQ ID NO: 61392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattctgggtttctctggag

SEQ ID NO: 61393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctggattctgggtttctctg

SEQ ID NO: 61394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactggattctgggtttctc

SEQ ID NO: 61395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactggattctgggtttct

SEQ ID NO: 61396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctactggattctgggtttc

SEQ ID NO: 61397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctactggattctgggttt

SEQ ID NO: 61398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtgcatgagtttttctac

SEQ ID NO: 61399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtgtgcatgagtttttct

SEQ ID NO: 61400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctctggtgtgcatgagtt

SEQ ID NO: 61401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcctctggtgtgcatgag

SEQ ID NO: 61402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcctctggtgtgcatga

SEQ ID NO: 61403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtcctctggtgtgcatg

SEQ ID NO: 61404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatgggtattttctgtcct

SEQ ID NO: 61405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatgggtattttctgtcc

SEQ ID NO: 61406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatatgggtattttctgtc

SEQ ID NO: 61407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccattttgatatgggtatt

SEQ ID NO: 61408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacccattttgatatgggta

SEQ ID NO: 61409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacccattttgatatgggt

SEQ ID NO: 61410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacccattttgatatggg

SEQ ID NO: 61411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctacccattttgatatgg

SEQ ID NO: 61412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctacccattttgatatg

SEQ ID NO: 61413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactttttctacccattttg

SEQ ID NO: 61414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactttttctacccatttt

SEQ ID NO: 61415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccactttttctacccattt

SEQ ID NO: 61416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgcatgagtgtctttccac

SEQ ID NO: 61417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggtggggttagtgcatga

SEQ ID NO: 61418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctcagggtggggttagtg

SEQ ID NO: 61419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaatgtaaggcactgtgc

SEQ ID NO: 61420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccaaatgtaaggcactgtg

SEQ ID NO: 61421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcccaaatgtaaggcactg

SEQ ID NO: 61422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcccaaatgtaaggcact

SEQ ID NO: 61423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcccaaatgtaaggcac

SEQ ID NO: 61424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttcttcccaaatgtaag

SEQ ID NO: 61425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttcttcccaaatgtaa

SEQ ID NO: 61426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaatttggttttcttccca

SEQ ID NO: 61427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaagtagctgcaaatttgg

SEQ ID NO: 61428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaagtagctgcaaatttg

SEQ ID NO: 61429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacccttgggaagtagctgc

SEQ ID NO: 61430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacccttgggaagtagct

SEQ ID NO: 61431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaacccttgggaagtagc

SEQ ID NO: 61432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtttctcaacccttggga

SEQ ID NO: 61433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtgtgctatagtttctc

SEQ ID NO: 61434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatatgtgtgctatagtttc

SEQ ID NO: 61435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttctatatgtgtgctata

SEQ ID NO: 61436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaagttgggttctata

SEQ ID NO: 61437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaaaaaaagttgggtt

SEQ ID NO: 61438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaattaaaaaaaagttgggt

SEQ ID NO: 61439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaaattaaaaaaaagttg

SEQ ID NO: 61440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaaattaaaaaaaagtt

SEQ ID NO: 61441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaataaatacatttcctta

SEQ ID NO: 61442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagaaataaatacatttcct

SEQ ID NO: 61443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagaaataaatacatttcc

SEQ ID NO: 61444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctagaaataaatacatttc

SEQ ID NO: 61445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaaaagcattttctagaaa

SEQ ID NO: 61446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagaaaaagcattttctaga

SEQ ID NO: 61447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactctagaaaaagcatttt

SEQ ID NO: 61448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactctagaaaaagcattt

SEQ ID NO: 61449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacactctagaaaaagcatt

SEQ ID NO: 61450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttacactctagaaaaagca

SEQ ID NO: 61451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttacactctagaaaaag

SEQ ID NO: 61452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctttacactctagaaaa

SEQ ID NO: 61453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctctttacactctagaaa

SEQ ID NO: 61454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctctctttacactctaga

SEQ ID NO: 61455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctcttctctctttacact

SEQ ID NO: 61456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatatagttcatctcttct

SEQ ID NO: 61457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatatagttcatctcttc

SEQ ID NO: 61458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatatagttcatctctt

SEQ ID NO: 61459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaagatgattttataatat

SEQ ID NO: 61460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaatggaaaaccaaggca

SEQ ID NO: 61461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaaatggaaaaccaagg

SEQ ID NO: 61462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttctacaaaatggaaaac

SEQ ID NO: 61463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaagttgggttctacaaa

SEQ ID NO: 61464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcagggcctataaaagtt

SEQ ID NO: 61465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgtcagggcctataaaag

SEQ ID NO: 61466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagccaagctctgtgtcag

SEQ ID NO: 61467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagcatggtgatctaaaagc

SEQ ID NO: 61468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaagcatggtgatctaaa

SEQ ID NO: 61469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccattcctcaagcatggtga

SEQ ID NO: 61470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccattcctcaagcatggt

SEQ ID NO: 61471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctgccattcctcaagca

SEQ ID NO: 61472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctctgccattcctcaagc

SEQ ID NO: 61473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatggcttatctctgccat

SEQ ID NO: 61474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagaaaactccaatggctt

SEQ ID NO: 61475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagagaaaactccaatggct

SEQ ID NO: 61476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttgagagaaaactccaa

SEQ ID NO: 61477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttgagagaaaactcca

SEQ ID NO: 61478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacttgagagaaaactcc

SEQ ID NO: 61479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtacttgagagaaaactc

SEQ ID NO: 61480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtacttgagagaaaact

SEQ ID NO: 61481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaccccccatcgtttttt

SEQ ID NO: 61482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcagttcaaaacccccca

SEQ ID NO: 61483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagtgctcaggcagttcaa

SEQ ID NO: 61484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagagtgctcaggcagttc

SEQ ID NO: 61485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgagagtgctcaggcagtt

SEQ ID NO: 61486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcttctgagagtgctcag

SEQ ID NO: 61487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcccaggaattaaagcttc

SEQ ID NO: 61488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagatggtctgatcccagg

SEQ ID NO: 61489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catggggaagttggaagatg

SEQ ID NO: 61490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatggggaagttggaagat

SEQ ID NO: 61491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggtttccatggggaagtt

SEQ ID NO: 61492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaaacgtgtagcctaatgg

SEQ ID NO: 61493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagaggccagaaccacagg

SEQ ID NO: 61494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtactggaagaggccag

SEQ ID NO: 61495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagtactggaagaggcca

SEQ ID NO: 61496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtagatttccaagtactgg

SEQ ID NO: 61497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatgtagatttccaagtac

SEQ ID NO: 61498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctatgtagatttccaagta

SEQ ID NO: 61499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttgctatgtagatttcca

SEQ ID NO: 61500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttgctatgtagatttcc

SEQ ID NO: 61501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatttgctatgtagattt

SEQ ID NO: 61502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttcatttgctatgtaga

SEQ ID NO: 61503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttcatttgctatgtag

SEQ ID NO: 61504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaaggtttattcttcatt

SEQ ID NO: 61505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctgaagaaggtttattct

SEQ ID NO: 61506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggctgaagaaggtttattc

SEQ ID NO: 61507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaggctgaagaaggttta

SEQ ID NO: 61508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttaggctgaagaaggttt

SEQ ID NO: 61509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtttaggctgaagaaggt

SEQ ID NO: 61510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttgtttaggctgaagaa

SEQ ID NO: 61511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcctcttgtttaggctgaa

SEQ ID NO: 61512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggaagccagggaagaagg

SEQ ID NO: 61513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggaggaagccagggaagaa

SEQ ID NO: 61514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctctggaggaagccaggga

SEQ ID NO: 61515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattgtctctggaggaagc

SEQ ID NO: 61516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagagttgggattgtctctg

SEQ ID NO: 61517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaaaaaaaaaaaaaaa

SEQ ID NO: 61518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catctcaaaaaaaaaaaaaa

SEQ ID NO: 61519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcgacagagcgagacagcg

SEQ ID NO: 61520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgggcgacagagcga

SEQ ID NO: 61521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctgggcgacag

SEQ ID NO: 61522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgccactgcactccagcctg

SEQ ID NO: 61523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagccgagattgcgcc

SEQ ID NO: 61524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcagtgagccgagattgcgc

SEQ ID NO: 61525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaatggcatgaa

SEQ ID NO: 61526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggaggctgaggcaggagaa

SEQ ID NO: 61527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcgggaggctgaggcagga

SEQ ID NO: 61528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcccagctactcgggag

SEQ ID NO: 61529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgggcgtggtagcgggcg

SEQ ID NO: 61530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaaattagccg

SEQ ID NO: 61531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaaattag

SEQ ID NO: 61532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaatacaaaaaatt

SEQ ID NO: 61533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acacggtgaaaccccgtctc

SEQ ID NO: 61534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaacacggtgaaaccccg

SEQ ID NO: 61535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccgaggcgggcggat

SEQ ID NO: 61536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccgaggcgggcgga

SEQ ID NO: 61537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccgaggcgggcgg

SEQ ID NO: 61538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagcactttgggag

SEQ ID NO: 61539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgcctgtaatcccagcact

SEQ ID NO: 61540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggccgggcgcggtggctca

SEQ ID NO: 61541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagaaagattgtggccggg

SEQ ID NO: 61542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagaaagattgtggccgg

SEQ ID NO: 61543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagaaagattgtggccg

SEQ ID NO: 61544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaagaaagattgtggcc

SEQ ID NO: 61545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacatcttttaaaagaaaga

SEQ ID NO: 61546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacatcttttaaaagaaag

SEQ ID NO: 61547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggtagagaccttccacat

SEQ ID NO: 61548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtggtagagaccttccaca

SEQ ID NO: 61549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggtggtagagaccttcca

SEQ ID NO: 61550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttggtggtagagacctt

SEQ ID NO: 61551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgttcttggtggtagagac

SEQ ID NO: 61552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgttcttggtggtagaga

SEQ ID NO: 61553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcaggagcaagccaggga

SEQ ID NO: 61554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataaattatgtcaggagca

SEQ ID NO: 61555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataagaaactgcataaatta

SEQ ID NO: 61556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taataagaaactgcataaat

SEQ ID NO: 61557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaataagaaactgcata

SEQ ID NO: 61558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctctaataagaaactgcat

SEQ ID NO: 61559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagccttcctctaataagaa

SEQ ID NO: 61560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgtagttcaagccttcc

SEQ ID NO: 61561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattaaagtgtagttcaagc

SEQ ID NO: 61562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggattaaagtgtagttca

SEQ ID NO: 61563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatctattggattaaagtgt

SEQ ID NO: 61564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagatctattggattaaag

SEQ ID NO: 61565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaatatctgttagatctat

SEQ ID NO: 61566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataaatatctgttagatct

SEQ ID NO: 61567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctataaatatctgttaga

SEQ ID NO: 61568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgaactgttctataaata

SEQ ID NO: 61569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggatgaactgttctataa

SEQ ID NO: 61570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgttggatgaactgttcta

SEQ ID NO: 61571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgctgttggatgaactgtt

SEQ ID NO: 61572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgctgttggatgaactgt

SEQ ID NO: 61573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgctgttggatgaactg

SEQ ID NO: 61574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagaatatgtattttgtt

SEQ ID NO: 61575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagaatatgtattttgt

SEQ ID NO: 61576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgatttgagaagaatat

SEQ ID NO: 61577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtgatttgagaagaata

SEQ ID NO: 61578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagagtgtttcatgtgattt

SEQ ID NO: 61579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcctggagagtgtttcatgt

SEQ ID NO: 61580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatgtgatctatcctggag

SEQ ID NO: 61581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggcctaacatgtgatcta

SEQ ID NO: 61582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtggcctaacatgtgatct

SEQ ID NO: 61583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttggtggcctaacatgtga

SEQ ID NO: 61584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttggtggcctaacatgtg

SEQ ID NO: 61585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacttgtttggtggcctaa

SEQ ID NO: 61586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaaacttgtttggtggcc

SEQ ID NO: 61587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaaacttgtttggtggc

SEQ ID NO: 61588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgttaaaacttgtttg

SEQ ID NO: 61589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatttgttaaaacttgttt

SEQ ID NO: 61590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaatttgttaaaacttgt

SEQ ID NO: 61591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaaatttgttaaaacttg

SEQ ID NO: 61592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttcttaaatttgttaaa

SEQ ID NO: 61593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcttcttaaatttgttaa

SEQ ID NO: 61594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcttcttaaatttgtta

SEQ ID NO: 61595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gatatgattttaatcttctt

SEQ ID NO: 61596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtcatcatgaacagaaaa

SEQ ID NO: 61597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtcatcatgaacagaaa

SEQ ID NO: 61598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttcatgtcatcatgaaca

SEQ ID NO: 61599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtttcatgtcatcatgaa

SEQ ID NO: 61600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagtttcatgtcatcatga

SEQ ID NO: 61601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttctagtttcatgtcatc

SEQ ID NO: 61602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacttctagtttcatgtc

SEQ ID NO: 61603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgacttctagtttcatgt

SEQ ID NO: 61604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattgacttctagtttcat

SEQ ID NO: 61605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttattgacttctagttt

SEQ ID NO: 61606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggttattcttattgactt

SEQ ID NO: 61607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaaggttattcttattga

SEQ ID NO: 61608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagttgttcaaggttattc

SEQ ID NO: 61609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacgtaattatgagttgttc

SEQ ID NO: 61610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacgtaattatgagttgtt

SEQ ID NO: 61611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttccacgtaattatgagt

SEQ ID NO: 61612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttccacgtaattatgag

SEQ ID NO: 61613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaatttccacgtaattat

SEQ ID NO: 61614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggagcatgttgtttaattt

SEQ ID NO: 61615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcaggagcatgttgtttaa

SEQ ID NO: 61616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgttcaggagcatgttgt

SEQ ID NO: 61617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acccattgcctgttcaggag

SEQ ID NO: 61618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacccattgcctgttcagga

SEQ ID NO: 61619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacccattgcctgttcagg

SEQ ID NO: 61620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgacccattgcctgttca

SEQ ID NO: 61621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttgacccattgcctgttc

SEQ ID NO: 61622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctttgacccattgcctgt

SEQ ID NO: 61623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctttgacccattgcctg

SEQ ID NO: 61624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtataatttcttctttgac

SEQ ID NO: 61625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgtataatttcttctttga

SEQ ID NO: 61626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgtataatttcttctttg

SEQ ID NO: 61627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccgtataatttcttcttt

SEQ ID NO: 61628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttccgtataatttcttc

SEQ ID NO: 61629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttttccgtataatttct

SEQ ID NO: 61630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttttccgtataatttc

SEQ ID NO: 61631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtttttccgtataattt

SEQ ID NO: 61632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcccaaaatattttctgtt

SEQ ID NO: 61633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattgatcccaaaatattt

SEQ ID NO: 61634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgtcattgatcccaaaa

SEQ ID NO: 61635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattgtcattgatcccaaa

SEQ ID NO: 61636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttccattgtcattgatc

SEQ ID NO: 61637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtttccattgtcattgat

SEQ ID NO: 61638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttgtgtttccattgtcat

SEQ ID NO: 61639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatcttgtgtttccattgt

SEQ ID NO: 61640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatcttgtgtttccattg

SEQ ID NO: 61641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgttatcttgtgtttcca

SEQ ID NO: 61642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catactatttgttatcttgt

SEQ ID NO: 61643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattccatactatttgttat

SEQ ID NO: 61644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacattccatactatttgtt

SEQ ID NO: 61645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacattccatactatttgt

SEQ ID NO: 61646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacattccatactatttg

SEQ ID NO: 61647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctacattccatactattt

SEQ ID NO: 61648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctacattccatactatt

SEQ ID NO: 61649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttctacattccatacta

SEQ ID NO: 61650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttctacattccatact

SEQ ID NO: 61651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggcttctttttctacatt

SEQ ID NO: 61652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagggcttctttttctaca

SEQ ID NO: 61653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcagggcttctttttcta

SEQ ID NO: 61654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctcagggcttctttttct

SEQ ID NO: 61655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctcagggcttctttttc

SEQ ID NO: 61656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctcagggcttcttttt

SEQ ID NO: 61657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaatttttctctcagggct

SEQ ID NO: 61658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctataaatttttctctcagg

SEQ ID NO: 61659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactataaatttttctctc

SEQ ID NO: 61660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactataaatttttctct

SEQ ID NO: 61661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtaggcatttattactat

SEQ ID NO: 61662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtaggcatttattacta

SEQ ID NO: 61663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatgtaggcatttattact

SEQ ID NO: 61664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaatgtaggcatttatta

SEQ ID NO: 61665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaatgtaggcatttatt

SEQ ID NO: 61666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttaatgtaggcatttat

SEQ ID NO: 61667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctttaatgtaggcattt

SEQ ID NO: 61668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttctttaatgtaggcatt

SEQ ID NO: 61669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctttctttaatgtaggc

SEQ ID NO: 61670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctttctttaatgtagg

SEQ ID NO: 61671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttctttctttaatgtag

SEQ ID NO: 61672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agattttccttctttcttta

SEQ ID NO: 61673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagattttccttctttcttt

SEQ ID NO: 61674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgagattttccttctttc

SEQ ID NO: 61675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgagattttccttcttt

SEQ ID NO: 61676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatttgagattttccttc

SEQ ID NO: 61677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttgtttatttgagatttt

SEQ ID NO: 61678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agatgtaatattaggttgtt

SEQ ID NO: 61679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagatgtaatattaggttg

SEQ ID NO: 61680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctctaagatgtaatatta

SEQ ID NO: 61681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatctctaagatgtaatat

SEQ ID NO: 61682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatctctaagatgtaata

SEQ ID NO: 61683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaatctctaagatgtaat

SEQ ID NO: 61684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaatctctaagatgtaa

SEQ ID NO: 61685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctaatctctaagatgta

SEQ ID NO: 61686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttctaatctctaagatg

SEQ ID NO: 61687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttctaatctctaagat

SEQ ID NO: 61688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctttttctaatctctaag

SEQ ID NO: 61689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttctttttctaatctct

SEQ ID NO: 61690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcttctttttctaatct

SEQ ID NO: 61691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggatattctgttcttcttt

SEQ ID NO: 61692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggatattctgttcttctt

SEQ ID NO: 61693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaagtttggggatattctg

SEQ ID NO: 61694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaagtttggggatattc

SEQ ID NO: 61695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcaaagtttggggatatt

SEQ ID NO: 61696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctgcaaagtttggggat

SEQ ID NO: 61697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttctgcaaagtttgggga

SEQ ID NO: 61698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccttctgcaaagtttggg

SEQ ID NO: 61699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccttctgcaaagtttgg

SEQ ID NO: 61700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttccttctgcaaagtttg

SEQ ID NO: 61701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcttccttctgcaaagt

SEQ ID NO: 61702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattttcttccttctgcaa

SEQ ID NO: 61703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttattttcttccttctgca

SEQ ID NO: 61704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttattttcttccttctgc

SEQ ID NO: 61705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttgttattttcttcctt

SEQ ID NO: 61706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcattatctttgttattttc

SEQ ID NO: 61707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcattatctttgttattt

SEQ ID NO: 61708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatcattatctttgttatt

SEQ ID NO: 61709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctatcattatctttgtt

SEQ ID NO: 61710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctatcattatctttgt

SEQ ID NO: 61711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatttctatcattatctt

SEQ ID NO: 61712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttatttctatcattatct

SEQ ID NO: 61713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttatttctatcattatc

SEQ ID NO: 61714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgtttatttctatcatt

SEQ ID NO: 61715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctttgtttatttctatcat

SEQ ID NO: 61716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatttgctttgtttatttc

SEQ ID NO: 61717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatttgctttgtttattt

SEQ ID NO: 61718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtatttgctttgtttatt

SEQ ID NO: 61719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtatttgctttgtttat

SEQ ID NO: 61720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagtatttgctttgttta

SEQ ID NO: 61721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaaaacaactttttagta

SEQ ID NO: 61722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaaaacaactttttagt

SEQ ID NO: 61723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaaaaacaactttttag

SEQ ID NO: 61724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaaaaaaacaacttttta

SEQ ID NO: 61725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttttcaaaaaaacaactt

SEQ ID NO: 61726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttttcaaaaaaacaact

SEQ ID NO: 61727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcttttcaaaaaaacaac

SEQ ID NO: 61728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gattttatcttttcaaaaaa

SEQ ID NO: 61729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgattttatcttttcaaaaa

SEQ ID NO: 61730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgattttatcttttcaaaa

SEQ ID NO: 61731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgattttatcttttcaaa

SEQ ID NO: 61732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggtttttcgattttatct

SEQ ID NO: 61733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaaaggtttttcgatttt

SEQ ID NO: 61734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctagttaaaggtttttcg

SEQ ID NO: 61735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttagtctagttaaaggttt

SEQ ID NO: 61736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttagtctagttaaaggtt

SEQ ID NO: 61737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttggttagtctagttaaa

SEQ ID NO: 61738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccttggttagtctagttaa

SEQ ID NO: 61739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccttggttagtctagtta

SEQ ID NO: 61740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccttggttagtctagtt

SEQ ID NO: 61741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcccttggttagtctagt

SEQ ID NO: 61742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcccttggttagtctag

SEQ ID NO: 61743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttttttcccttggttagt

SEQ ID NO: 61744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgtcttttttcccttgg

SEQ ID NO: 61745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttgtcttttttcccttg

SEQ ID NO: 61746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgagttgtcttttttccc

SEQ ID NO: 61747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatattgtttgagttgtct

SEQ ID NO: 61748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagatattgtttgagttgtc

SEQ ID NO: 61749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcagatattgtttgagt

SEQ ID NO: 61750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttcagatattgtttgag

SEQ ID NO: 61751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttcagatattgtttga

SEQ ID NO: 61752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatttcagatattgttt

SEQ ID NO: 61753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttcatttcagatattgtt

SEQ ID NO: 61754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttctttcatttcagatat

SEQ ID NO: 61755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctcccttctttcatttca

SEQ ID NO: 61756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagtgttagtctcccttct

SEQ ID NO: 61757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgttatcagtgttagtct

SEQ ID NO: 61758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgttatcagtgttagtc

SEQ ID NO: 61759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttatgtgttatcagtgt

SEQ ID NO: 61760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatttatgtgttatcagtg

SEQ ID NO: 61761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtatttatgtgttatca

SEQ ID NO: 61762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgattccttgtatttatgtg

SEQ ID NO: 61763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgattccttgtatttatgt

SEQ ID NO: 61764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagtttatgattccttgta

SEQ ID NO: 61765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattaatagtttatgattc

SEQ ID NO: 61766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcacattaatagtttatga

SEQ ID NO: 61767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggtgtatggttgttcaca

SEQ ID NO: 61768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatggtgtatggttgttcac

SEQ ID NO: 61769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttgatggtgtatggttg

SEQ ID NO: 61770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaatttgatggtgtatgg

SEQ ID NO: 61771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggttattcaatttgatggtg

SEQ ID NO: 61772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggttattcaatttgatgg

SEQ ID NO: 61773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaggttattcaatttgatg

SEQ ID NO: 61774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctaggttattcaatttg

SEQ ID NO: 61775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attccttctaggttattcaa

SEQ ID NO: 61776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcattccttctaggttat

SEQ ID NO: 61777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagattagttcattccttct

SEQ ID NO: 61778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagattagttcattcctt

SEQ ID NO: 61779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaagattagttcattcct

SEQ ID NO: 61780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtttctaaagattagtt

SEQ ID NO: 61781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaggttgcatgtttctaaa

SEQ ID NO: 61782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaggttgcatgtttctaa

SEQ ID NO: 61783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcttggtaggttgcatgtt

SEQ ID NO: 61784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcttggtaggttgcatgt

SEQ ID NO: 61785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttagtcttggtaggttgc

SEQ ID NO: 61786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatttagtcttggtaggttg

SEQ ID NO: 61787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgatttagtcttggtaggt

SEQ ID NO: 61788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgatttagtcttggtagg

SEQ ID NO: 61789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatgtaatatttcttgatt

SEQ ID NO: 61790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcagatgtaatatttcttg

SEQ ID NO: 61791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcagatgtaatatttctt

SEQ ID NO: 61792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttgttcagatgtaatatt

SEQ ID NO: 61793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccagtattggtttgttcag

SEQ ID NO: 61794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccagtattggtttgttca

SEQ ID NO: 61795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatccagtattggtttgttc

SEQ ID NO: 61796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatccagtattggtttgt

SEQ ID NO: 61797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttatccagtattggtttg

SEQ ID NO: 61798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttatccagtattggttt

SEQ ID NO: 61799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttctttatccagtattgg

SEQ ID NO: 61800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctattttctttatccagt

SEQ ID NO: 61801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatctattttctttatcc

SEQ ID NO: 61802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactgatctattttcttta

SEQ ID NO: 61803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactgatctattttcttt

SEQ ID NO: 61804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttattactgatctatttt

SEQ ID NO: 61805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttattactgatctattt

SEQ ID NO: 61806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagacttaatttattactg

SEQ ID NO: 61807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaggagacttaatttatt

SEQ ID NO: 61808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttaggagacttaatttat

SEQ ID NO: 61809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttaggagacttaattta

SEQ ID NO: 61810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggttaggagacttaattt

SEQ ID NO: 61811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggttaggagacttaatt

SEQ ID NO: 61812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttggttaggagacttaat

SEQ ID NO: 61813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttggttaggagacttaa

SEQ ID NO: 61814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttggttaggagactta

SEQ ID NO: 61815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttggttaggagactt

SEQ ID NO: 61816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttggttaggagact

SEQ ID NO: 61817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttggttaggagac

SEQ ID NO: 61818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttggttaggaga

SEQ ID NO: 61819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttggttaggag

SEQ ID NO: 61820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttttggttagga

SEQ ID NO: 61821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttttttttttttggtta

SEQ ID NO: 61822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttttttttttttggtt

SEQ ID NO: 61823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttttttttttttttggt

SEQ ID NO: 61824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccttttttttttttttgg

SEQ ID NO: 61825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accagtgaccttttcctttt

SEQ ID NO: 61826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagaattcaccagtgacc

SEQ ID NO: 61827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatagaattcaccagtgac

SEQ ID NO: 61828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatagaattcaccagtga

SEQ ID NO: 61829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaatagaattcaccagt

SEQ ID NO: 61830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttaaatagaattcaccag

SEQ ID NO: 61831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttctttaaatagaattcac

SEQ ID NO: 61832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattacttctttaaataga

SEQ ID NO: 61833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagaattcatattacttc

SEQ ID NO: 61834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagaattcatattactt

SEQ ID NO: 61835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagaatttgagaagaattc

SEQ ID NO: 61836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaagaatttgagaagaatt

SEQ ID NO: 61837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaagaatttgagaagaat

SEQ ID NO: 61838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggaagaatttgagaagaa

SEQ ID NO: 61839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggaagaatttgagaaga

SEQ ID NO: 61840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttttggaagaatttga

SEQ ID NO: 61841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttttggaagaatttg

SEQ ID NO: 61842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattttttggaagaattt

SEQ ID NO: 61843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaattttttggaagaatt

SEQ ID NO: 61844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttcaattttttggaaga

SEQ ID NO: 61845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctccttttcaattttttg

SEQ ID NO: 61846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctccttttcaatttttt

SEQ ID NO: 61847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaaatgaatttgacctcc

SEQ ID NO: 61848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctcataaaatgaatttga

SEQ ID NO: 61849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcagtataatactggcc

SEQ ID NO: 61850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatcagtataatactggc

SEQ ID NO: 61851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatcagtataatactgg

SEQ ID NO: 61852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggttttcatatcagtataa

SEQ ID NO: 61853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggttttcatatcagtata

SEQ ID NO: 61854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagggttttcatatcagta

SEQ ID NO: 61855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtagcatactcttagggttt

SEQ ID NO: 61856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtagcatactcttagggt

SEQ ID NO: 61857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggtagcatactcttaggg

SEQ ID NO: 61858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggtagcatactcttagg

SEQ ID NO: 61859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctggtagcatactcttag

SEQ ID NO: 61860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttctggtagcatactctt

SEQ ID NO: 61861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttctggtagcatactct

SEQ ID NO: 61862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttctggtagcatactc

SEQ ID NO: 61863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagttttcttttctggtagc

SEQ ID NO: 61864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctgcagttttcttttctg

SEQ ID NO: 61865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaagaatattggcctgca

SEQ ID NO: 61866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttcatcaagaatattggc

SEQ ID NO: 61867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatctatgttcatcaagaat

SEQ ID NO: 61868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatctatgttcatcaagaa

SEQ ID NO: 61869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggatctatgttcatcaaga

SEQ ID NO: 61870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggatctatgttcatcaag

SEQ ID NO: 61871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatttttggatctatgtt

SEQ ID NO: 61872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtgaatttttggatctat

SEQ ID NO: 61873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatattgttgtgaattttt

SEQ ID NO: 61874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaatatattgttgtgaatt

SEQ ID NO: 61875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaatatattgttgtgaat

SEQ ID NO: 61876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttgctaatatattgttg

SEQ ID NO: 61877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggaattcagtttgctaata

SEQ ID NO: 61878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtgctagggaattcagt

SEQ ID NO: 61879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtgctagggaattcag

SEQ ID NO: 61880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgtgctagggaattca

SEQ ID NO: 61881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agataaatcccaagtaatca

SEQ ID NO: 61882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catccctcagataaatccca

SEQ ID NO: 61883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatccctcagataaatccc

SEQ ID NO: 61884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatccctcagataaatcc

SEQ ID NO: 61885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcatccctcagataaatc

SEQ ID NO: 61886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatttttgcatccctcag

SEQ ID NO: 61887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccatttttgcatccctca

SEQ ID NO: 61888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatgtttaaccatttttg

SEQ ID NO: 61889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatgtttaaccattttt

SEQ ID NO: 61890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttatgtatgtttaaccat

SEQ ID NO: 61891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatttatgtatgtttaac

SEQ ID NO: 61892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgatttatgtatgtttaa

SEQ ID NO: 61893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtagcatatcacatttat

SEQ ID NO: 61894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgtagcatatcacatt

SEQ ID NO: 61895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaatgtagcatatcacat

SEQ ID NO: 61896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaatgtagcatatcaca

SEQ ID NO: 61897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgttaatgtagcatatc

SEQ ID NO: 61898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttgttaatgtagcatat

SEQ ID NO: 61899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattttgttaatgtagcat

SEQ ID NO: 61900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttattttgttaatgtag

SEQ ID NO: 61901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcttattttgttaatgta

SEQ ID NO: 61902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttcttattttgttaatgt

SEQ ID NO: 61903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttcttattttgttaatg

SEQ ID NO: 61904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaagatgatcatatgattt

SEQ ID NO: 61905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catctagtaagatgatcata

SEQ ID NO: 61906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgcatctagtaagatgat

SEQ ID NO: 61907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgcatctagtaagatga

SEQ ID NO: 61908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctgcatctagtaagatg

SEQ ID NO: 61909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaatgctttgtctgcatc

SEQ ID NO: 61910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaaatgctttgtctgcat

SEQ ID NO: 61911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaaatgctttgtctgca

SEQ ID NO: 61912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattttatcaaatgctttgt

SEQ ID NO: 61913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaacatatgctggatttta

SEQ ID NO: 61914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgaacatatgctggatt

SEQ ID NO: 61915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatgaacatatgctggat

SEQ ID NO: 61916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatgaacatatgctgga

SEQ ID NO: 61917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agattttattatgaacatat

SEQ ID NO: 61918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgagattttattatgaaca

SEQ ID NO: 61919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgagattttattatgaac

SEQ ID NO: 61920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttgagattttattatgaa

SEQ ID NO: 61921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttgttgagattttattat

SEQ ID NO: 61922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatctgctttgttgagat

SEQ ID NO: 61923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatatctgctttgttgaga

SEQ ID NO: 61924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccatatctgctttgttg

SEQ ID NO: 61925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtacattccttccatatc

SEQ ID NO: 61926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaggtacattccttccat

SEQ ID NO: 61927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaggtacattccttcca

SEQ ID NO: 61928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaggtacattccttcc

SEQ ID NO: 61929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgttaaggtacattcct

SEQ ID NO: 61930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgttaaggtacattcc

SEQ ID NO: 61931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattttgttaaggtacattc

SEQ ID NO: 61932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatatatggctttattttg

SEQ ID NO: 61933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcatatatggctttatttt

SEQ ID NO: 61934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgtgggcttgtcatatat

SEQ ID NO: 61935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataatgttagccgtgggct

SEQ ID NO: 61936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataatgttagccgtgggc

SEQ ID NO: 61937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcataatgttagccgtggg

SEQ ID NO: 61938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcataatgttagccgtgg

SEQ ID NO: 61939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttttgcataatgttagc

SEQ ID NO: 61940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtttttgcataatgttag

SEQ ID NO: 61941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtttttgcataatgtta

SEQ ID NO: 61942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagtttttgcataatgtt

SEQ ID NO: 61943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaacttttcagtttttgca

SEQ ID NO: 61944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagaaaagctcccaacttt

SEQ ID NO: 61945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaagaaaagctcccaactt

SEQ ID NO: 61946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcttagaagaaaagctccc

SEQ ID NO: 61947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatcttagaagaaaagct

SEQ ID NO: 61948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcctgatcttagaagaaaa

SEQ ID NO: 61949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcctgatcttagaagaaa

SEQ ID NO: 61950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttgttcctgatcttagaa

SEQ ID NO: 61951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcttgttcctgatcttaga

SEQ ID NO: 61952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcaaaaagaagtggtaat

SEQ ID NO: 61953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtactatgtcaaaaagaagt

SEQ ID NO: 61954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtactatgtcaaaaagaa

SEQ ID NO: 61955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagtactatgtcaaaaaga

SEQ ID NO: 61956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggatgggatttctagtact

SEQ ID NO: 61957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatggatgggatttctagt

SEQ ID NO: 61958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgctatggatgggatttc

SEQ ID NO: 61959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctaattgctatggatggga

SEQ ID NO: 61960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcctaattgctatggatg

SEQ ID NO: 61961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgcctaattgctatggat

SEQ ID NO: 61962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgcctaattgctatgga

SEQ ID NO: 61963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctgcctaattgctatgg

SEQ ID NO: 61964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcctgcctaattgctatg

SEQ ID NO: 61965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttcctgcctaattgcta

SEQ ID NO: 61966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttcctgcctaattgct

SEQ ID NO: 61967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctttttcctgcctaatt

SEQ ID NO: 61968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctttttcctgcctaat

SEQ ID NO: 61969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttctttttcctgcctaa

SEQ ID NO: 61970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catggatgtattttatttct

SEQ ID NO: 61971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatggatgtattttatttc

SEQ ID NO: 61972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacatggatgtattttatt

SEQ ID NO: 61973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttacatggatgtattttat

SEQ ID NO: 61974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttacatggatgtatttta

SEQ ID NO: 61975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcttacatggatgtatt

SEQ ID NO: 61976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctttcttacatggatgtat

SEQ ID NO: 61977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctttcttacatggatgt

SEQ ID NO: 61978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgctttcttacatggatg

SEQ ID NO: 61979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttgctttcttacatgg

SEQ ID NO: 61980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttgctttcttacatg

SEQ ID NO: 61981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcttgctttcttacat

SEQ ID NO: 61982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaacagagataattttat

SEQ ID NO: 61983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catataaagatcatgtcatt

SEQ ID NO: 61984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatataaagatcatgtca

SEQ ID NO: 61985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacatataaagatcatgtc

SEQ ID NO: 61986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacatataaagatcatgt

SEQ ID NO: 61987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggttttctacatataaag

SEQ ID NO: 61988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtagagtgttcagggtttt

SEQ ID NO: 61989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagtagagtgttcagggtt

SEQ ID NO: 61990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagttctcagtagagtgtt

SEQ ID NO: 61991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacagttctcagtagagtgt

SEQ ID NO: 61992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacagttctcagtagagtg

SEQ ID NO: 61993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatcagttttaacagttc

SEQ ID NO: 61994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatcagttttaacagtt

SEQ ID NO: 61995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatttatgtatcagttttaa

SEQ ID NO: 61996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaatttatgtatcagttt

SEQ ID NO: 61997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaatttatgtatcagtt

SEQ ID NO: 61998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactgaatttatgtatcagt

SEQ ID NO: 61999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caactttactgaatttatgt

SEQ ID NO: 62000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaactgcaactttactgaa

SEQ ID NO: 62001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaactgcaactttactga

SEQ ID NO: 62002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaaactgcaactttactg

SEQ ID NO: 62003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttgcaaactgcaacttt

SEQ ID NO: 62004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttgattttgcaaactgca

SEQ ID NO: 62005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgttgattttgcaaactg

SEQ ID NO: 62006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgttgattttgcaaact

SEQ ID NO: 62007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatgttgattttgcaaac

SEQ ID NO: 62008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatgttgattttgcaaa

SEQ ID NO: 62009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttttctatgttgattttg

SEQ ID NO: 62010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgatttttctatgttgatt

SEQ ID NO: 62011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtatagaaatgctactga

SEQ ID NO: 62012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgtatagaaatgctac

SEQ ID NO: 62013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgttaatgtatagaaatg

SEQ ID NO: 62014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatacctcattgttaatgta

SEQ ID NO: 62015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggatacctcattgttaat

SEQ ID NO: 62016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttggatacctcattgttaa

SEQ ID NO: 62017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttggatacctcattgtta

SEQ ID NO: 62018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgttggatacctcattgt

SEQ ID NO: 62019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgttggatacctcattg

SEQ ID NO: 62020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttctttgttggatacctc

SEQ ID NO: 62021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttctttgttggatacct

SEQ ID NO: 62022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatttctttgttggatac

SEQ ID NO: 62023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaatttctttgttggata

SEQ ID NO: 62024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcttaatttctttgttg

SEQ ID NO: 62025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataggattaatttcttaat

SEQ ID NO: 62026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaataggattaatttcttaa

SEQ ID NO: 62027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaataggattaatttctta

SEQ ID NO: 62028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttaaataggattaatttc

SEQ ID NO: 62029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgctgttttaaataggatt

SEQ ID NO: 62030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgctgttttaaataggat

SEQ ID NO: 62031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatgctgttttaaatagga

SEQ ID NO: 62032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgatgctgttttaaata

SEQ ID NO: 62033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgatgctgttttaaat

SEQ ID NO: 62034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattttgatgctgtttta

SEQ ID NO: 62035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttattttgatgctgtttt

SEQ ID NO: 62036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttattttgatgctgt

SEQ ID NO: 62037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttattttgatgctg

SEQ ID NO: 62038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatttattttgatgct

SEQ ID NO: 62039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagtattttatttatttat

SEQ ID NO: 62040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagtattttatttattta

SEQ ID NO: 62041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcaaagtattttatttat

SEQ ID NO: 62042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttcaaagtattttattta

SEQ ID NO: 62043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttacttcaaagtatttt

SEQ ID NO: 62044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttaaatttacttcaaagta

SEQ ID NO: 62045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggttaaatttacttcaaa

SEQ ID NO: 62046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctggttaaatttacttcaa

SEQ ID NO: 62047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctggttaaatttacttca

SEQ ID NO: 62048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactttcctggttaaattta

SEQ ID NO: 62049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caactttcctggttaaattt

SEQ ID NO: 62050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtacagatcttcaactt

SEQ ID NO: 62051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgtacagatcttcaact

SEQ ID NO: 62052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtgtacagatcttcaac

SEQ ID NO: 62053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagttttcagtgtacagatc

SEQ ID NO: 62054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagttttcagtgtacagat

SEQ ID NO: 62055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcaacttatagttttcag

SEQ ID NO: 62056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcaacttatagttttca

SEQ ID NO: 62057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatcaacttatagttttc

SEQ ID NO: 62058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatcaacttatagtttt

SEQ ID NO: 62059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatcaacttatagttt

SEQ ID NO: 62060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaatcaacttatagtt

SEQ ID NO: 62061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtttttttaaatcaactta

SEQ ID NO: 62062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcagtttttttaaatcaac

SEQ ID NO: 62063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcagtttttttaaatcaa

SEQ ID NO: 62064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcttcctcagttttttta

SEQ ID NO: 62065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcttcctcagttttttt

SEQ ID NO: 62066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtgtcttcctcagtttt

SEQ ID NO: 62067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtgtcttcctcagttt

SEQ ID NO: 62068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatttatttgtgtcttcct

SEQ ID NO: 62069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caacacatgaacatgaaata

SEQ ID NO: 62070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaacacatgaacatgaaat

SEQ ID NO: 62071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccaacacatgaacatgaa

SEQ ID NO: 62072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcttccaacacatgaaca

SEQ ID NO: 62073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaatattaattcttccaac

SEQ ID NO: 62074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaatattaattcttccaa

SEQ ID NO: 62075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacaatattaattcttcca

SEQ ID NO: 62076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtagtatggacattttaac

SEQ ID NO: 62077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtagtatggacattttaa

SEQ ID NO: 62078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggtagtatggacatttta

SEQ ID NO: 62079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgggtagtatggacatt

SEQ ID NO: 62080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagattattttgggtagtat

SEQ ID NO: 62081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatctgtagattattttggg

SEQ ID NO: 62082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattgaatctgtagattatt

SEQ ID NO: 62083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagggattgcattgaatct

SEQ ID NO: 62084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatagggattgcattgaatc

SEQ ID NO: 62085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatagggattgcattgaat

SEQ ID NO: 62086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattttgatagggattgca

SEQ ID NO: 62087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acattagaattttgataggg

SEQ ID NO: 62088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaaactgacattagaatt

SEQ ID NO: 62089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgaaaactgacattagaa

SEQ ID NO: 62090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgaaaactgacattaga

SEQ ID NO: 62091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctgtgaaaactgacatt

SEQ ID NO: 62092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatttctgtgaaaactgac

SEQ ID NO: 62093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatttctgtgaaaactga

SEQ ID NO: 62094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactatttctgtgaaaactg

SEQ ID NO: 62095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactatttctgtgaaaact

SEQ ID NO: 62096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactatttctgtgaaaac

SEQ ID NO: 62097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattttttactatttctgt

SEQ ID NO: 62098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgttaggattttttact

SEQ ID NO: 62099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaaatgttaggatttttt

SEQ ID NO: 62100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaaatgttaggattttt

SEQ ID NO: 62101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcaaatgttaggatttt

SEQ ID NO: 62102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttattcaaatgttaggat

SEQ ID NO: 62103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttattcaaatgttagga

SEQ ID NO: 62104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttattcaaatgttagg

SEQ ID NO: 62105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttattcaaatgttag

SEQ ID NO: 62106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttattcaaatgtta

SEQ ID NO: 62107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttattttattcaaatgtt

SEQ ID NO: 62108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatcttttttattttattc

SEQ ID NO: 62109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatcttttttattttatt

SEQ ID NO: 62110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccatttagcatctttttta

SEQ ID NO: 62111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccatttagcatctttttt

SEQ ID NO: 62112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggccatttagcatcttttt

SEQ ID NO: 62113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttggccatttagcatctt

SEQ ID NO: 62114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agattgctttggccatttag

SEQ ID NO: 62115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcagattgctttggccatt

SEQ ID NO: 62116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcagattgctttggccat

SEQ ID NO: 62117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctcagattgctttggcca

SEQ ID NO: 62118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctcagattgctttggcc

SEQ ID NO: 62119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgctcagattgctttggc

SEQ ID NO: 62120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgctcagattgctttg

SEQ ID NO: 62121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctttttgctcagattgct

SEQ ID NO: 62122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctttttgctcagattgc

SEQ ID NO: 62123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttctttttgctcagattg

SEQ ID NO: 62124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctttgttctttttgctcag

SEQ ID NO: 62125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagctttgttctttttgctc

SEQ ID NO: 62126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacctctagctttgttcttt

SEQ ID NO: 62127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgacagagtattgcacc

SEQ ID NO: 62128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatgacagagtattgcac

SEQ ID NO: 62129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaatgacagagtattgca

SEQ ID NO: 62130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttgaaatgacagagta

SEQ ID NO: 62131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttgaaatgacagagt

SEQ ID NO: 62132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatattttgaaatgacagag

SEQ ID NO: 62133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgccaatagcatagctttat

SEQ ID NO: 62134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgccaatagcatagcttta

SEQ ID NO: 62135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtttatgccaatagcatag

SEQ ID NO: 62136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaatatatctgtgtttat

SEQ ID NO: 62137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattagccaatatatctgtg

SEQ ID NO: 62138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattagccaatatatctgt

SEQ ID NO: 62139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccattagccaatatatctg

SEQ ID NO: 62140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccattagccaatatatct

SEQ ID NO: 62141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccttttccattagccaata

SEQ ID NO: 62142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccttttccattagccaat

SEQ ID NO: 62143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccttttccattagccaa

SEQ ID NO: 62144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatccttttccattagcca

SEQ ID NO: 62145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatccttttccattagcc

SEQ ID NO: 62146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctttttatccttttccat

SEQ ID NO: 62147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggctttttatccttttcc

SEQ ID NO: 62148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggctttttatccttttc

SEQ ID NO: 62149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgggctttttatcctt

SEQ ID NO: 62150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctgggctttttatcct

SEQ ID NO: 62151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtttatttctgggcttttt

SEQ ID NO: 62152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaataattgggtttatttc

SEQ ID NO: 62153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actataaataattgggttta

SEQ ID NO: 62154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaatcaattgactataaat

SEQ ID NO: 62155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaaatcaattgactata

SEQ ID NO: 62156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgaaaatcaattgactat

SEQ ID NO: 62157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctgaaaatcaattgacta

SEQ ID NO: 62158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacctttgctgaaaatcaat

SEQ ID NO: 62159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacctttgctgaaaatcaa

SEQ ID NO: 62160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcacctttgctgaaaatca

SEQ ID NO: 62161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgcacctttgctgaaaat

SEQ ID NO: 62162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctttgcacctttgctgaa

SEQ ID NO: 62163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctttgcacctttgctga

SEQ ID NO: 62164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttattctttgcacctttgc

SEQ ID NO: 62165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccccattgtttattctttgc

SEQ ID NO: 62166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccccattgtttattctttg

SEQ ID NO: 62167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccccattgtttattcttt

SEQ ID NO: 62168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagatcgtcctttccccc

SEQ ID NO: 62169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaagagatcgtcctttcc

SEQ ID NO: 62170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaagagatcgtcctttc

SEQ ID NO: 62171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaacaccatttattgaaga

SEQ ID NO: 62172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaacaccatttattgaag

SEQ ID NO: 62173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccaacaccatttattgaa

SEQ ID NO: 62174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttttcccaacaccattta

SEQ ID NO: 62175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataaggaatattcagtttt

SEQ ID NO: 62176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataaggaatattcagttt

SEQ ID NO: 62177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcataaggaatattcagtt

SEQ ID NO: 62178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcataaggaatattcagt

SEQ ID NO: 62179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgcataaggaatattca

SEQ ID NO: 62180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcttttgcataaggaata

SEQ ID NO: 62181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcttttgcataaggaat

SEQ ID NO: 62182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacatatggtatgagaaa

SEQ ID NO: 62183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaacatatggtatgagaa

SEQ ID NO: 62184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataaacatatggtatgaga

SEQ ID NO: 62185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttataaacatatggtat

SEQ ID NO: 62186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttataaacatatggta

SEQ ID NO: 62187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttggttttataaacatatg

SEQ ID NO: 62188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttggttttataaacatat

SEQ ID NO: 62189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgtttggttttataaaca

SEQ ID NO: 62190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttgtttggttttataaac

SEQ ID NO: 62191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttgtttggttttataaa

SEQ ID NO: 62192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacttgtttggttttataa

SEQ ID NO: 62193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcttttacttgtttggtt

SEQ ID NO: 62194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtcttttacttgtttggt

SEQ ID NO: 62195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttaagtcttttacttgt

SEQ ID NO: 62196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatttaagtcttttacttg

SEQ ID NO: 62197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatatttaagtcttttact

SEQ ID NO: 62198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatatttaagtcttttac

SEQ ID NO: 62199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcttatatttaagtctt

SEQ ID NO: 62200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttcttatatttaagtct

SEQ ID NO: 62201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtttcatttcttatattt

SEQ ID NO: 62202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtttcatttcttatatt

SEQ ID NO: 62203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagtttcatttcttatat

SEQ ID NO: 62204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtagctttatagtttcattt

SEQ ID NO: 62205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtagctttatagtttcat

SEQ ID NO: 62206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagtagctttatagtttca

SEQ ID NO: 62207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctagtagctttatagttt

SEQ ID NO: 62208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctagtagctttatagtt

SEQ ID NO: 62209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctagtagctttatagt

SEQ ID NO: 62210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttttcttctagtagcttt

SEQ ID NO: 62211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgttttcttctagtagctt

SEQ ID NO: 62212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgttttcttctagtagct

SEQ ID NO: 62213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgttttcttctagtagc

SEQ ID NO: 62214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttatgttttcttctagta

SEQ ID NO: 62215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttatgttttcttctagt

SEQ ID NO: 62216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttatgttttcttctag

SEQ ID NO: 62217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttttatgttttcttcta

SEQ ID NO: 62218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccagataaatgtcatacag

SEQ ID NO: 62219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcccagataaatgtcataca

SEQ ID NO: 62220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccaagaaatccttgcccag

SEQ ID NO: 62221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtcctagccaagaaatcc

SEQ ID NO: 62222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtcctagccaagaaatc

SEQ ID NO: 62223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagtcctagccaagaaat

SEQ ID NO: 62224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagagtcctagccaagaaa

SEQ ID NO: 62225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcttttagagtcctagcca

SEQ ID NO: 62226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgtgcttttagagtccta

SEQ ID NO: 62227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacctgtgcttttagagtc

SEQ ID NO: 62228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttacctgtgcttttagagt

SEQ ID NO: 62229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttacctgtgcttttagag

SEQ ID NO: 62230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttacctgtgcttttaga

SEQ ID NO: 62231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttttgttacctgtgcttt

SEQ ID NO: 62232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtcttttgttacctgtgc

SEQ ID NO: 62233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtcttttgttacctgtg

SEQ ID NO: 62234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttattgtcttttgttacctg

SEQ ID NO: 62235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcttattgtcttttgtta

SEQ ID NO: 62236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctcttattgtcttttgtt

SEQ ID NO: 62237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccaacttgtctcttattg

SEQ ID NO: 62238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctaatccaacttgtctct

SEQ ID NO: 62239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatctaatccaacttgtctc

SEQ ID NO: 62240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttgatctaatccaacttg

SEQ ID NO: 62241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttgatctaatccaactt

SEQ ID NO: 62242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtttgatctaatccaact

SEQ ID NO: 62243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtttgatctaatccaac

SEQ ID NO: 62244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaagaacatttttagtttg

SEQ ID NO: 62245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtaaagaacatttttagt

SEQ ID NO: 62246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtaaagaacatttttag

SEQ ID NO: 62247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtttgctgtaaagaacattt

SEQ ID NO: 62248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgtttgctgtaaagaacatt

SEQ ID NO: 62249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttcgtttgctgtaaagaac

SEQ ID NO: 62250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcttcgtttgctgtaaag

SEQ ID NO: 62251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattgcttcgtttgctgta

SEQ ID NO: 62252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttattgcttcgtttgctg

SEQ ID NO: 62253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cactctgttattgcttcgtt

SEQ ID NO: 62254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccactctgttattgcttcg

SEQ ID NO: 62255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctccactctgttattgctt

SEQ ID NO: 62256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctccactctgttattgc

SEQ ID NO: 62257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatccatgatctctctctcc

SEQ ID NO: 62258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatccatgatctctctctc

SEQ ID NO: 62259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcaatccatgatctctct

SEQ ID NO: 62260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcaatccatgatctctc

SEQ ID NO: 62261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcaatccatgatctct

SEQ ID NO: 62262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagatattttatttcaatcc

SEQ ID NO: 62263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagatattttatttcaatc

SEQ ID NO: 62264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagatgtatggtttgcaga

SEQ ID NO: 62265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcagatgtatggtttgcag

SEQ ID NO: 62266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcagatgtatggtttgca

SEQ ID NO: 62267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccctttatcagatgtatgg

SEQ ID NO: 62268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatattagccctttatcaga

SEQ ID NO: 62269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtataatgttggatattag

SEQ ID NO: 62270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtataatgttggatatta

SEQ ID NO: 62271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtataatgttggatatt

SEQ ID NO: 62272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtataatgttggatat

SEQ ID NO: 62273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatgtataatgttggata

SEQ ID NO: 62274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctttttatgtataatgtt

SEQ ID NO: 62275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagctttttatgtataatgt

SEQ ID NO: 62276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgagctttttatgtataa

SEQ ID NO: 62277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgcttgagctttttatg

SEQ ID NO: 62278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgttgagttgcttgagct

SEQ ID NO: 62279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggtgttgagttgcttgag

SEQ ID NO: 62280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaggtgttgagttgcttga

SEQ ID NO: 62281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaggtgttgagttgcttg

SEQ ID NO: 62282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttctaggtgttgagttg

SEQ ID NO: 62283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgattttctaggtgttgag

SEQ ID NO: 62284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgattttctaggtgttga

SEQ ID NO: 62285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttattgattttctaggtg

SEQ ID NO: 62286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caattggtttattgattttc

SEQ ID NO: 62287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaattggtttattgattt

SEQ ID NO: 62288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccattctacaattggttta

SEQ ID NO: 62289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccattctacaattggttt

SEQ ID NO: 62290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcccattctacaattgg

SEQ ID NO: 62291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattatttgcccattctac

SEQ ID NO: 62292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagattatttgcccattc

SEQ ID NO: 62293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaatgtctgttcagatta

SEQ ID NO: 62294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaatgtctgttcagatt

SEQ ID NO: 62295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaaatgtctgttcagat

SEQ ID NO: 62296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagaaatgtctgttcaga

SEQ ID NO: 62297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgagaaatgtctgttca

SEQ ID NO: 62298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgagaaatgtctgttc

SEQ ID NO: 62299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttttgagaaatgtctgt

SEQ ID NO: 62300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatctcttcttttgagaaa

SEQ ID NO: 62301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccattcatatctcttcttt

SEQ ID NO: 62302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggccattcatatctcttc

SEQ ID NO: 62303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatatctattggccattca

SEQ ID NO: 62304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatatctattggccattc

SEQ ID NO: 62305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatatatctattggccatt

SEQ ID NO: 62306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatatatctattggccat

SEQ ID NO: 62307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatatatctattggcca

SEQ ID NO: 62308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcattttttaatatatcta

SEQ ID NO: 62309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagatgttgagcatttttta

SEQ ID NO: 62310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgattagagatgttgagca

SEQ ID NO: 62311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgattagagatgttgag

SEQ ID NO: 62312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatgattagagatgttga

SEQ ID NO: 62313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgatgattagagatgttg

SEQ ID NO: 62314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgatgattagagatgtt

SEQ ID NO: 62315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttttctgatgattagag

SEQ ID NO: 62316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatttttctgatgattaga

SEQ ID NO: 62317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgcatttttctgatgat

SEQ ID NO: 62318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttgcatttttctgatga

SEQ ID NO: 62319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttgcatttttctgatg

SEQ ID NO: 62320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattttaatttgcattttt

SEQ ID NO: 62321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgggattttaatttgcat

SEQ ID NO: 62322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgggattttaatttgca

SEQ ID NO: 62323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaggtgtgaggtaatattt

SEQ ID NO: 62324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggaggtgtgaggtaatat

SEQ ID NO: 62325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataacagccattctaggagg

SEQ ID NO: 62326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataacagccattctaggag

SEQ ID NO: 62327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgataacagccattctagga

SEQ ID NO: 62328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgataacagccattctagg

SEQ ID NO: 62329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgataacagccattctag

SEQ ID NO: 62330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctttttgataacagccat

SEQ ID NO: 62331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattcatctttttgataac

SEQ ID NO: 62332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatcattcatctttttgat

SEQ ID NO: 62333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttatcattcatctttttga

SEQ ID NO: 62334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcaacacttgttatcattc

SEQ ID NO: 62335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatcctcatcaacacttg

SEQ ID NO: 62336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacatcctcatcaacact

SEQ ID NO: 62337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacatcctcatcaacac

SEQ ID NO: 62338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctccacatcctcatcaa

SEQ ID NO: 62339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttctccacatcctcat

SEQ ID NO: 62340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaatgtataagggttccta

SEQ ID NO: 62341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaacaatgtataagggtt

SEQ ID NO: 62342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactaacaatgtataagggt

SEQ ID NO: 62343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactaacaatgtataaggg

SEQ ID NO: 62344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattttcactaacaatgtat

SEQ ID NO: 62345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattttcactaacaatgta

SEQ ID NO: 62346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttacattttcactaacaa

SEQ ID NO: 62347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactaatttacattttcact

SEQ ID NO: 62348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacagctgtactaatttac

SEQ ID NO: 62349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaacagctgtactaattt

SEQ ID NO: 62350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaacagctgtactaatt

SEQ ID NO: 62351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaaacagctgtactaat

SEQ ID NO: 62352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcaaacagctgtactaa

SEQ ID NO: 62353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttctcaaacagctgtac

SEQ ID NO: 62354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgctatttttctcaaaca

SEQ ID NO: 62355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatgctatttttctcaaac

SEQ ID NO: 62356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaacttccatgctattttt

SEQ ID NO: 62357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaacttccatgctatttt

SEQ ID NO: 62358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggaacttccatgctattt

SEQ ID NO: 62359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgggaacttccatgcta

SEQ ID NO: 62360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgggaacttccatgct

SEQ ID NO: 62361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttgttttgggaacttcc

SEQ ID NO: 62362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggtaattgtatttgttt

SEQ ID NO: 62363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattatatggtaattgtatt

SEQ ID NO: 62364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaattatatggtaattgt

SEQ ID NO: 62365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagtggaattgctgaatta

SEQ ID NO: 62366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatacctagaagtggaattg

SEQ ID NO: 62367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatataccactatatacc

SEQ ID NO: 62368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggaattaaatatatacca

SEQ ID NO: 62369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaggaattaaatatatac

SEQ ID NO: 62370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaaaggaattaaatata

SEQ ID NO: 62371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcctctaaaggaattaaa

SEQ ID NO: 62372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattcctctaaaggaattaa

SEQ ID NO: 62373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattcctctaaaggaatta

SEQ ID NO: 62374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagaacgattttaattcct

SEQ ID NO: 62375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagaacgattttaattcc

SEQ ID NO: 62376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacagaacgattttaattc

SEQ ID NO: 62377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatgaacatgggagtgcag

SEQ ID NO: 62378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaataatgctgaaatgaac

SEQ ID NO: 62379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaataatgctgaaatgaa

SEQ ID NO: 62380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtaaataatgctgaaatg

SEQ ID NO: 62381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttcttgtaaataatgctga

SEQ ID NO: 62382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttcttgtaaataatgctg

SEQ ID NO: 62383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatgtcttggttcttgtaa

SEQ ID NO: 62384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caccaacctaatatgtcttg

SEQ ID NO: 62385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaccaacctaatatgtctt

SEQ ID NO: 62386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgcaccaacctaatat

SEQ ID NO: 62387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caattacatttgcaccaacc

SEQ ID NO: 62388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcaaaagtaatggtaaaa

SEQ ID NO: 62389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgcagcaaaagtaatggt

SEQ ID NO: 62390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgcagcaaaagtaatgg

SEQ ID NO: 62391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattgcagcaaaagtaatg

SEQ ID NO: 62392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaattgcagcaaaagtaat

SEQ ID NO: 62393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttaattgcagcaaaagt

SEQ ID NO: 62394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccattacttttaattgcag

SEQ ID NO: 62395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccattacttttaattgca

SEQ ID NO: 62396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggccattacttttaattgc

SEQ ID NO: 62397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cggttttggccattactttt

SEQ ID NO: 62398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgcaaaagtaattgcggtt

SEQ ID NO: 62399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtatgggttagtgcaaa

SEQ ID NO: 62400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgggtacaggttgcatgta

SEQ ID NO: 62401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgatgggtacaggttgcat

SEQ ID NO: 62402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctgttgatgggtacaggt

SEQ ID NO: 62403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcacctgttgatgggtac

SEQ ID NO: 62404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcattcacctgttgatggg

SEQ ID NO: 62405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcattcacctgttgatgg

SEQ ID NO: 62406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcattcacctgttgatg

SEQ ID NO: 62407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttattcattcacctgttga

SEQ ID NO: 62408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttattcattcacctgttg

SEQ ID NO: 62409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttattcattcacctgtt

SEQ ID NO: 62410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacattttctttattcatt

SEQ ID NO: 62411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcatacctatcacattttc

SEQ ID NO: 62412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagtagtgcactgtgcat

SEQ ID NO: 62413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatagtagtgcactgtgca

SEQ ID NO: 62414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatagtagtgcactgtgc

SEQ ID NO: 62415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttttgtatagtagtgca

SEQ ID NO: 62416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagttttgtatagtagtgc

SEQ ID NO: 62417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagttttgtatagtagtg

SEQ ID NO: 62418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaagttttgtatagtagt

SEQ ID NO: 62419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttaaagttttgtatagta

SEQ ID NO: 62420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttttaaagttttgtata

SEQ ID NO: 62421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcttttaaagttttgtat

SEQ ID NO: 62422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatgaatgacaaaatttgt

SEQ ID NO: 62423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttgggatgaatgacaaa

SEQ ID NO: 62424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcatgttgggatgaatga

SEQ ID NO: 62425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcatgttgggatgaatg

SEQ ID NO: 62426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcattcatgttgggatg

SEQ ID NO: 62427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttcattcatgttgggat

SEQ ID NO: 62428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttcattcatgttggga

SEQ ID NO: 62429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcataacgtcctttagtttc

SEQ ID NO: 62430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcataacgtcctttagttt

SEQ ID NO: 62431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttagcataacgtcctttag

SEQ ID NO: 62432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttagcataacgtccttta

SEQ ID NO: 62433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttagcataacgtccttt

SEQ ID NO: 62434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgcttagcataacgtc

SEQ ID NO: 62435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaattttgcttagcataa

SEQ ID NO: 62436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacctggctaattttgctta

SEQ ID NO: 62437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtacctggctaattttgct

SEQ ID NO: 62438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtacctggctaattttgc

SEQ ID NO: 62439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgtacctggctaattttg

SEQ ID NO: 62440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttctgtacctggctaat

SEQ ID NO: 62441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctttctgtacctggctaa

SEQ ID NO: 62442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgtaagtgagatcatgtg

SEQ ID NO: 62443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgtaagtgagatcatgt

SEQ ID NO: 62444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatgtaagtgagatcatg

SEQ ID NO: 62445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccccaccccattttacatg

SEQ ID NO: 62446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccccctccccccaccccatt

SEQ ID NO: 62447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccctcccccctccccccac

SEQ ID NO: 62448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgctatccctcccccctcc

SEQ ID NO: 62449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaatgctatccctcccccc

SEQ ID NO: 62450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatatctcctaatgctat

SEQ ID NO: 62451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaggtatatctcctaat

SEQ ID NO: 62452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattaggtatatctcctaa

SEQ ID NO: 62453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtcatttacattaggtatat

SEQ ID NO: 62454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcgtcatttacattaggt

SEQ ID NO: 62455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtgcggcacccattaact

SEQ ID NO: 62456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatgtatacatgtgccat

SEQ ID NO: 62457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacatatgtatacatgtgc

SEQ ID NO: 62458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttacatatgtatacatgtg

SEQ ID NO: 62459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtacatgtgcacaacgtg

SEQ ID NO: 62460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggtacatgtgcacaacg

SEQ ID NO: 62461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttctagggtacatgtgca

SEQ ID NO: 62462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttctagggtacatgtgc

SEQ ID NO: 62463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagttctagggtacatgtg

SEQ ID NO: 62464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttaagttctagggtacat

SEQ ID NO: 62465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttaagttctagggtaca

SEQ ID NO: 62466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactttaagttctagggtac

SEQ ID NO: 62467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttactttaagttctaggg

SEQ ID NO: 62468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttactttaagttctagg

SEQ ID NO: 62469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttactttaagttctag

SEQ ID NO: 62470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttactttaagttcta

SEQ ID NO: 62471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttactttaagttct

SEQ ID NO: 62472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttattttactttaagttc

SEQ ID NO: 62473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttattttactttaag

SEQ ID NO: 62474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttattttactttaa

SEQ ID NO: 62475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttttttattttactt

SEQ ID NO: 62476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttttttattttact

SEQ ID NO: 62477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttatttttttatttt

SEQ ID NO: 62478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttatttttttattt

SEQ ID NO: 62479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatttatttttttatt

SEQ ID NO: 62480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttatttatttttttat

SEQ ID NO: 62481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttatttattttttta

SEQ ID NO: 62482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttatttatttattttt

SEQ ID NO: 62483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttatttatttatttt

SEQ ID NO: 62484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttatttatttattt

SEQ ID NO: 62485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttatttatttatt

SEQ ID NO: 62486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttatttatttat

SEQ ID NO: 62487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttattttttatttattta

SEQ ID NO: 62488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttttttattttttattta

SEQ ID NO: 62489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacttttttattttttatt

SEQ ID NO: 62490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcacttttttattttttat

SEQ ID NO: 62491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttctcacttttttatttt

SEQ ID NO: 62492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatgttgacttctcacttt

SEQ ID NO: 62493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaatgttgacttctcact

SEQ ID NO: 62494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtaatgttgacttctcac

SEQ ID NO: 62495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttctgtaatgttgacttct

SEQ ID NO: 62496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgctgtttctgtaatgtt

SEQ ID NO: 62497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgctgtttctgtaatgt

SEQ ID NO: 62498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatgctgtttctgtaatg

SEQ ID NO: 62499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggcaaccacctttatatgc

SEQ ID NO: 62500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccccagtcctatggcaacca

SEQ ID NO: 62501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccccagtcctatggcaacc

SEQ ID NO: 62502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacatcgtcttcccccagtc

SEQ ID NO: 62503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacatcgtcttcccccag

SEQ ID NO: 62504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacatcgtcttccccca

SEQ ID NO: 62505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctccacatcgtcttccccc

SEQ ID NO: 62506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactttctccacatcgtctt

SEQ ID NO: 62507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactttctccacatcgtct

SEQ ID NO: 62508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaagatttatactttctc

SEQ ID NO: 62509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcaagatttatactttct

SEQ ID NO: 62510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatcaagatttatactttc

SEQ ID NO: 62511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgaaaaatgtacatcctt

SEQ ID NO: 62512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaatgaaaaatgtacatcc

SEQ ID NO: 62513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctaaatgaaaaatgtaca

SEQ ID NO: 62514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactctaaatgaaaaatgta

SEQ ID NO: 62515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctactctaaatgaaaaat

SEQ ID NO: 62516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcctctactctaaatgaaa

SEQ ID NO: 62517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcctctactctaaatgaa

SEQ ID NO: 62518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatttattcctctactcta

SEQ ID NO: 62519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagatttattcctctactct

SEQ ID NO: 62520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccatcttaagatttattc

SEQ ID NO: 62521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatccatcttaagatttatt

SEQ ID NO: 62522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatccatcttaagatttat

SEQ ID NO: 62523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtctttaatccatcttaag

SEQ ID NO: 62524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtctttaatccatcttaa

SEQ ID NO: 62525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttaagtctttaatccat

SEQ ID NO: 62526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttaagtctttaatcca

SEQ ID NO: 62527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatttaagtctttaatcc

SEQ ID NO: 62528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattttacatttaagtcttt

SEQ ID NO: 62529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattttacatttaagtctt

SEQ ID NO: 62530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagattttacatttaagtct

SEQ ID NO: 62531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagttttagattttacattt

SEQ ID NO: 62532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagttttagattttacatt

SEQ ID NO: 62533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatagttttagattttacat

SEQ ID NO: 62534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatagttttagattttaca

SEQ ID NO: 62535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagggtttttatagttttag

SEQ ID NO: 62536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagggtttttatagtttta

SEQ ID NO: 62537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttccagggtttttatagt

SEQ ID NO: 62538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctgtcttccagggttttt

SEQ ID NO: 62539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaggctgtcttccagggt

SEQ ID NO: 62540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatggtattgcctaggctgt

SEQ ID NO: 62541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcctgaatggtattgcct

SEQ ID NO: 62542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatgcctatgtcctgaat

SEQ ID NO: 62543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccatgcctatgtcctgaa

SEQ ID NO: 62544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccatgcctatgtcctga

SEQ ID NO: 62545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatgaaatctttgcccat

SEQ ID NO: 62546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcatgaaatctttgccca

SEQ ID NO: 62547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcttcatcatgaaatct

SEQ ID NO: 62548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtcttcatcatgaaatc

SEQ ID NO: 62549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgtcttcatcatgaaat

SEQ ID NO: 62550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggtgtcttcatcatgaaa

SEQ ID NO: 62551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttggtgtcttcatcatg

SEQ ID NO: 62552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagttgcttttggtgtcttc

SEQ ID NO: 62553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcagttgcttttggtgtc

SEQ ID NO: 62554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgcagttgcttttggtgt

SEQ ID NO: 62555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgcagttgcttttggtg

SEQ ID NO: 62556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgcagttgcttttggt

SEQ ID NO: 62557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgttgcagttgctttt

SEQ ID NO: 62558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttgttgcagttgcttt

SEQ ID NO: 62559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttttgttgcagttgctt

SEQ ID NO: 62560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttttgttgcagttgct

SEQ ID NO: 62561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttgtttttgttgcagt

SEQ ID NO: 62562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatttttgtttttgttgc

SEQ ID NO: 62563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaatttttgtttttgttg

SEQ ID NO: 62564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcccatttgttaattttt

SEQ ID NO: 62565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagatcccatttgttaat

SEQ ID NO: 62566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattagatcccatttgttaa

SEQ ID NO: 62567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttaattagatcccatttg

SEQ ID NO: 62568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttaattagatcccattt

SEQ ID NO: 62569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttaattagatcccatt

SEQ ID NO: 62570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttagtttaattagatccca

SEQ ID NO: 62571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcagaagctctttagttta

SEQ ID NO: 62572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgcagaagctctttagt

SEQ ID NO: 62573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtgcagaagctctttag

SEQ ID NO: 62574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgtgcagaagctcttta

SEQ ID NO: 62575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctgtgcagaagctcttt

SEQ ID NO: 62576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgctgtgcagaagctct

SEQ ID NO: 62577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgctgtgcagaagctc

SEQ ID NO: 62578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagtttcttttgctgtgca

SEQ ID NO: 62579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgatagtttcttttgctgt

SEQ ID NO: 62580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttgatagtttcttttgct

SEQ ID NO: 62581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgttgatagtttctttt

SEQ ID NO: 62582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actctgttgatagtttcttt

SEQ ID NO: 62583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttactctgttgatagtttc

SEQ ID NO: 62584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgcttactctgttgatag

SEQ ID NO: 62585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagactgtctgcttactctg

SEQ ID NO: 62586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtagactgtctgcttactc

SEQ ID NO: 62587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattctgtagactgtctgc

SEQ ID NO: 62588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccattctgtagactgtct

SEQ ID NO: 62589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccattctgtagactgtc

SEQ ID NO: 62590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccattctgtagactgt

SEQ ID NO: 62591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaaattttctcccattct

SEQ ID NO: 62592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagatgcatagtctgcaaa

SEQ ID NO: 62593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagatgcatagtctgcaa

SEQ ID NO: 62594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcagatgcatagtctgca

SEQ ID NO: 62595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacctttgtcagatgcatag

SEQ ID NO: 62596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatattagacctttgtcaga

SEQ ID NO: 62597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatattagacctttgtca

SEQ ID NO: 62598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagattctggatattagacc

SEQ ID NO: 62599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagattctggatattagac

SEQ ID NO: 62600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttatagattctggatatta

SEQ ID NO: 62601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttccttatagattctgga

SEQ ID NO: 62602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttccttatagattctgg

SEQ ID NO: 62603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttaagttccttatagatt

SEQ ID NO: 62604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaactcatttaagttcctt

SEQ ID NO: 62605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaactcatttaagttcct

SEQ ID NO: 62606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtaaactcatttaagttc

SEQ ID NO: 62607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtaaactcatttaagtt

SEQ ID NO: 62608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttgtaaactcatttaa

SEQ ID NO: 62609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttgtaaactcattta

SEQ ID NO: 62610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatttcttgtaaactcat

SEQ ID NO: 62611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggggttgtttatttcttg

SEQ ID NO: 62612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggggttgtttatttctt

SEQ ID NO: 62613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatggggttgtttatttct

SEQ ID NO: 62614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatggggttgtttatttc

SEQ ID NO: 62615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaatggggttgtttattt

SEQ ID NO: 62616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccactttttaatggggttg

SEQ ID NO: 62617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccactttttaatggggtt

SEQ ID NO: 62618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccactttttaatggggt

SEQ ID NO: 62619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcctttgcccacttttt

SEQ ID NO: 62620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatatcctttgcccactt

SEQ ID NO: 62621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagtgtctgttcatatcc

SEQ ID NO: 62622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaagtgtctgttcatatc

SEQ ID NO: 62623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaagtgtctgttcatat

SEQ ID NO: 62624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagaagtgtctgttcata

SEQ ID NO: 62625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcagaagtgtctgttca

SEQ ID NO: 62626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttcagaagtgtctgttc

SEQ ID NO: 62627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgtgtgtcttcttttcag

SEQ ID NO: 62628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcatgtgtgtcttctttt

SEQ ID NO: 62629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgcatgtgtgtcttcttt

SEQ ID NO: 62630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgttgcatgtgtgtcttc

SEQ ID NO: 62631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgttgcatgtgtgtctt

SEQ ID NO: 62632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgcttgtttgttgcatg

SEQ ID NO: 62633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgcttgtttgttgcat

SEQ ID NO: 62634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatgcttgtttgttgca

SEQ ID NO: 62635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatatgcttgtttgttgc

SEQ ID NO: 62636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatatgcttgtttgttg

SEQ ID NO: 62637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcatatgcttgtttgtt

SEQ ID NO: 62638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttcatatgcttgtttgt

SEQ ID NO: 62639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctttttttcatatgcttg

SEQ ID NO: 62640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggtcagtgacattgagct

SEQ ID NO: 62641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatggtcagtgacattgag

SEQ ID NO: 62642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaatggtcagtgacattg

SEQ ID NO: 62643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaatggtcagtgacatt

SEQ ID NO: 62644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttctctaatggtcagtg

SEQ ID NO: 62645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatttctctaatggtcagt

SEQ ID NO: 62646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgcatttctctaatggt

SEQ ID NO: 62647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgcatttctctaatgg

SEQ ID NO: 62648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgcatttctctaatg

SEQ ID NO: 62649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttttgatttgcatttct

SEQ ID NO: 62650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgtggttttgatttgcat

SEQ ID NO: 62651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtgagatggtatctcatt

SEQ ID NO: 62652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actggtgtgagatggtatct

SEQ ID NO: 62653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgactggtgtgagatggtat

SEQ ID NO: 62654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatagccattctgactgg

SEQ ID NO: 62655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataatagccattctgactg

SEQ ID NO: 62656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataatagccattctgact

SEQ ID NO: 62657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcataatagccattctgac

SEQ ID NO: 62658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcataatagccattctga

SEQ ID NO: 62659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttcataatagccatt

SEQ ID NO: 62660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactttttcataatagccat

SEQ ID NO: 62661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgactttttcataatagcca

SEQ ID NO: 62662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgactttttcataatagcc

SEQ ID NO: 62663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgactttttcataatagc

SEQ ID NO: 62664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttgactttttcataat

SEQ ID NO: 62665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattttttgactttttcat

SEQ ID NO: 62666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gccagcatctgttatttttt

SEQ ID NO: 62667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacaccctcgccagcatctg

SEQ ID NO: 62668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacaccctcgccagcatc

SEQ ID NO: 62669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacaccctcgccagcat

SEQ ID NO: 62670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctccacaccctcgccagca

SEQ ID NO: 62671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctccacaccctcgccagc

SEQ ID NO: 62672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctccacaccctcgccag

SEQ ID NO: 62673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctccacaccctcgcca

SEQ ID NO: 62674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttctccacaccctcgcc

SEQ ID NO: 62675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttctccacaccctcg

SEQ ID NO: 62676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatcaacagtgtgtaggca

SEQ ID NO: 62677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactcccatcaacagtgtgt

SEQ ID NO: 62678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactcccatcaacagtgtg

SEQ ID NO: 62679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttacactcccatcaacag

SEQ ID NO: 62680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattaatttacactcccatc

SEQ ID NO: 62681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggttgaattaatttacact

SEQ ID NO: 62682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattatggttgaattaattt

SEQ ID NO: 62683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccattatggttgaattaatt

SEQ ID NO: 62684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccacacagtcttccattatg

SEQ ID NO: 62685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaattgccacacagtctt

SEQ ID NO: 62686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggaattgccacacagtct

SEQ ID NO: 62687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaggaattgccacacagtc

SEQ ID NO: 62688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtctttgaggaattgccac

SEQ ID NO: 62689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtctttgaggaattgcca

SEQ ID NO: 62690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggtctttgaggaattgcc

SEQ ID NO: 62691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttaggtctttgaggaat

SEQ ID NO: 62692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtctttaggtctttgagga

SEQ ID NO: 62693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtctttaggtctttgagg

SEQ ID NO: 62694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatggcatttctgtctttag

SEQ ID NO: 62695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttgaatggcatttctgtc

SEQ ID NO: 62696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgggttgaatggcatttct

SEQ ID NO: 62697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatatacccagtaatggg

SEQ ID NO: 62698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtatatacccagtaatgg

SEQ ID NO: 62699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggtatatacccagtaatg

SEQ ID NO: 62700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctttaggtatatacccagt

SEQ ID NO: 62701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctttaggtatatacccag

SEQ ID NO: 62702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatagaaaaatgtatttcc

SEQ ID NO: 62703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatagaaaaatgtatttc

SEQ ID NO: 62704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataatagaaaaatgtattt

SEQ ID NO: 62705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caataaacatatgtgtgcat

SEQ ID NO: 62706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatagtgctccaataaac

SEQ ID NO: 62707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattgtgaatagtgctcca

SEQ ID NO: 62708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccattgtgaatagtgctcc

SEQ ID NO: 62709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgccattgtgaatagtgctc

SEQ ID NO: 62710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtctttgccattgtgaata

SEQ ID NO: 62711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtctttgccattgtgaa

SEQ ID NO: 62712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attctatgtctttgccattg

SEQ ID NO: 62713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgattctatgtctttgc

SEQ ID NO: 62714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttgattctatgtctttg

SEQ ID NO: 62715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggtcatttgagttgattc

SEQ ID NO: 62716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcactgatggtcatttgagt

SEQ ID NO: 62717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccagtctatcactgatggt

SEQ ID NO: 62718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccagtctatcactgatgg

SEQ ID NO: 62719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatccagtctatcactgatg

SEQ ID NO: 62720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttatccagtctatcact

SEQ ID NO: 62721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacattatctttatccagt

SEQ ID NO: 62722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accacattatctttatccag

SEQ ID NO: 62723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggtatatatttaccaca

SEQ ID NO: 62724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catagtattatatggtatat

SEQ ID NO: 62725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatggctgcatagtattata

SEQ ID NO: 62726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatggctgcatagtattat

SEQ ID NO: 62727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatggctgcatagtatta

SEQ ID NO: 62728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaatggctgcatagtatt

SEQ ID NO: 62729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaatggctgcatagtat

SEQ ID NO: 62730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgaatggctgcatagta

SEQ ID NO: 62731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgaatggctgcatagt

SEQ ID NO: 62732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgaatggctgcatag

SEQ ID NO: 62733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtttttttttgaatggctgc

SEQ ID NO: 62734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaggatatgatctcgttt

SEQ ID NO: 62735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtccctgcaaaggatatg

SEQ ID NO: 62736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattcatgtccctgcaaagg

SEQ ID NO: 62737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctccattcatgtccctg

SEQ ID NO: 62738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaaaatggcctccagctc

SEQ ID NO: 62739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaatgaaaatggcctccag

SEQ ID NO: 62740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaatgaaaatggcctcca

SEQ ID NO: 62741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttactaatgaaaatggcc

SEQ ID NO: 62742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttactaatgaaaatggc

SEQ ID NO: 62743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttagtttactaatgaaaa

SEQ ID NO: 62744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgccttagtttactaatga

SEQ ID NO: 62745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcctgccttagtttactaa

SEQ ID NO: 62746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcctgccttagtttact

SEQ ID NO: 62747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttcctgccttagtttac

SEQ ID NO: 62748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgttcctgccttagttta

SEQ ID NO: 62749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttctgttcctgccttag

SEQ ID NO: 62750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttctgttcctgcctta

SEQ ID NO: 62751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtgagaacatgtggtat

SEQ ID NO: 62752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataagtgagaacatgtggta

SEQ ID NO: 62753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacttataagtgagaacat

SEQ ID NO: 62754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctcccacttataagtgaga

SEQ ID NO: 62755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctcccacttataagtgag

SEQ ID NO: 62756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcatttagctcccacttat

SEQ ID NO: 62757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatcatttagctcccactt

SEQ ID NO: 62758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtccatgtgttctcatc

SEQ ID NO: 62759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgtccatgtgttctcat

SEQ ID NO: 62760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgtgtccatgtgttctca

SEQ ID NO: 62761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctttatgtgtccatgtgt

SEQ ID NO: 62762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaccctttatgtgtccatg

SEQ ID NO: 62763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccataggccccagtgtgtgt

SEQ ID NO: 62764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accctcccataggccccagt

SEQ ID NO: 62765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccctcccataggccccag

SEQ ID NO: 62766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacccttcaccctcccata

SEQ ID NO: 62767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcccacccttcaccctccc

SEQ ID NO: 62768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcccacccttcaccctcc

SEQ ID NO: 62769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttcctcccacccttcaccc

SEQ ID NO: 62770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccttcctcccacccttcac

SEQ ID NO: 62771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accctctccttcctcccacc

SEQ ID NO: 62772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaccctctccttcctccc

SEQ ID NO: 62773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgaccctctccttcctcc

SEQ ID NO: 62774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgaccctctccttcctc

SEQ ID NO: 62775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctgaccctctccttcct

SEQ ID NO: 62776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcctgaccctctcctt

SEQ ID NO: 62777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttatttttcctgaccctct

SEQ ID NO: 62778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcccagtatgcattggtta

SEQ ID NO: 62779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtattaatcccagtatgc

SEQ ID NO: 62780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccctgaggtattaatccc

SEQ ID NO: 62781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catccctgaggtattaatcc

SEQ ID NO: 62782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcatccctgaggtattaa

SEQ ID NO: 62783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacagattatttcatccctg

SEQ ID NO: 62784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtacagattatttcatcc

SEQ ID NO: 62785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtacagattatttcatc

SEQ ID NO: 62786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataggtaaacatgtcatag

SEQ ID NO: 62787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacataggtaaacatgtca

SEQ ID NO: 62788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttacataggtaaacatgtc

SEQ ID NO: 62789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggggtacatgtacaggatg

SEQ ID NO: 62790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttcaggggtacatgtaca

SEQ ID NO: 62791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttcaggggtacatgtac

SEQ ID NO: 62792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagttcaggggtacatgta

SEQ ID NO: 62793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaagttcaggggtacat

SEQ ID NO: 62794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttaagttcaggggtaca

SEQ ID NO: 62795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttaagttcaggggtac

SEQ ID NO: 62796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattttaagttcaggggta

SEQ ID NO: 62797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttttattttaagttcagg

SEQ ID NO: 62798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacttttattttaagttcag

SEQ ID NO: 62799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacttttattttaagttca

SEQ ID NO: 62800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgacttttattttaagttc

SEQ ID NO: 62801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgacttttattttaagtt

SEQ ID NO: 62802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttgacttttattttaagt

SEQ ID NO: 62803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgacttttttgactttta

SEQ ID NO: 62804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgtgacttttttgactt

SEQ ID NO: 62805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattgtgtgacttttttga

SEQ ID NO: 62806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctattgtgtgacttttttg

SEQ ID NO: 62807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcctattgtgtgacttt

SEQ ID NO: 62808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttcctattgtgtgactt

SEQ ID NO: 62809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttcctattgtgtgact

SEQ ID NO: 62810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatttcctattgtgtgac

SEQ ID NO: 62811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatttcctattgtgtga

SEQ ID NO: 62812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcatttcctattgtgtg

SEQ ID NO: 62813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttcatttcctattgt

SEQ ID NO: 62814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttcatttcctattg

SEQ ID NO: 62815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatatacatttattttttt

SEQ ID NO: 62816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatatacatttatttttt

SEQ ID NO: 62817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaatatacatttattttt

SEQ ID NO: 62818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaattttgaaatatacatt

SEQ ID NO: 62819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaattttgaaatatacat

SEQ ID NO: 62820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcaattttgaaatataca

SEQ ID NO: 62821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagcaattttgaaatatac

SEQ ID NO: 62822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttagcaattttgaaatat

SEQ ID NO: 62823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcttttagcaattttgaaa

SEQ ID NO: 62824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagctattcttttagcaa

SEQ ID NO: 62825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtaagaaagttaaaaagc

SEQ ID NO: 62826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggtaagaaagttaaaaag

SEQ ID NO: 62827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggtaagaaagttaaaaa

SEQ ID NO: 62828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtggtaagaaagttaaaa

SEQ ID NO: 62829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtggtaagaaagttaaa

SEQ ID NO: 62830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtggtaagaaagttaa

SEQ ID NO: 62831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttttttgtggtaagaa

SEQ ID NO: 62832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcatttttttgtggtaaga

SEQ ID NO: 62833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccacttatcatttttttg

SEQ ID NO: 62834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacccacttatcattttttt

SEQ ID NO: 62835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acataaccatcacttcaccc

SEQ ID NO: 62836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attaacataaccatcacttc

SEQ ID NO: 62837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcacgctaattaacataa

SEQ ID NO: 62838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtcacgctaattaacata

SEQ ID NO: 62839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtcacgctaattaacat

SEQ ID NO: 62840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaaattttcagtcacgct

SEQ ID NO: 62841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cataaacattgtagaaattt

SEQ ID NO: 62842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctacataaacattgtaga

SEQ ID NO: 62843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatctacataaacattgtag

SEQ ID NO: 62844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatctacataaacattgta

SEQ ID NO: 62845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggggtacaaaacaatgttt

SEQ ID NO: 62846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggggtacaaaacaatgtt

SEQ ID NO: 62847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatggggtacaaaacaat

SEQ ID NO: 62848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttatggggtacaaaacaa

SEQ ID NO: 62849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcttatttatggggtacaa

SEQ ID NO: 62850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaaaattgtgcttattta

SEQ ID NO: 62851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgacaaaaattgtgctta

SEQ ID NO: 62852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgacaaaaattgtgctt

SEQ ID NO: 62853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattgacaaaaattgtgct

SEQ ID NO: 62854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattgacaaaaattgtgc

SEQ ID NO: 62855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttaattgacaaaaatt

SEQ ID NO: 62856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatttttaattgacaaaa

SEQ ID NO: 62857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcatttttaattgacaaa

SEQ ID NO: 62858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatttgttcatttttaat

SEQ ID NO: 62859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatttgttcatttttaa

SEQ ID NO: 62860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaaatatttgttcatttt

SEQ ID NO: 62861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttaaatatttgttcatt

SEQ ID NO: 62862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttaaatatttgttcat

SEQ ID NO: 62863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtttaaatatttgttca

SEQ ID NO: 62864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgtttaaatatttgttc

SEQ ID NO: 62865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgtttaaatatttgtt

SEQ ID NO: 62866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctgtttaaatatttgt

SEQ ID NO: 62867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtatgtttttttctgttt

SEQ ID NO: 62868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtagtatgtttttttctgt

SEQ ID NO: 62869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctgtagtatgtttttttc

SEQ ID NO: 62870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttctgtagtatgttttttt

SEQ ID NO: 62871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagggatcttgttctgta

SEQ ID NO: 62872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttcatcagggatcttgtt

SEQ ID NO: 62873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catctatgttcatcagggat

SEQ ID NO: 62874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatctatgttcatcaggga

SEQ ID NO: 62875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcatctatgttcatcag

SEQ ID NO: 62876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaagttatttgcatctat

SEQ ID NO: 62877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgaagttatttgcatcta

SEQ ID NO: 62878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatgaagttatttgcatct

SEQ ID NO: 62879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattttgatgaagttattt

SEQ ID NO: 62880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaatattttgatgaagtta

SEQ ID NO: 62881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaatattttgatgaagtt

SEQ ID NO: 62882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttgctaatattttgatg

SEQ ID NO: 62883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattcagtttgctaatattt

SEQ ID NO: 62884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcattcagtttgctaata

SEQ ID NO: 62885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgggctgttgcattcagtt

SEQ ID NO: 62886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgggctgttgcattcagt

SEQ ID NO: 62887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcgtagtacatgatcattt

SEQ ID NO: 62888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtcgtagtacatgatcatt

SEQ ID NO: 62889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacttggtcgtagtacatg

SEQ ID NO: 62890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggacaactcccacttggtc

SEQ ID NO: 62891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcctagggacaactccca

SEQ ID NO: 62892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatcctagggacaactccc

SEQ ID NO: 62893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaccatccttgcatcctagg

SEQ ID NO: 62894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatgttgaaccatccttg

SEQ ID NO: 62895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtctgcatatgttgaaccat

SEQ ID NO: 62896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggtctgcatatgttgaac

SEQ ID NO: 62897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatcatgtggtgtatcaca

SEQ ID NO: 62898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagatcatgtggtgtatca

SEQ ID NO: 62899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcagatcatgtggtgtatc

SEQ ID NO: 62900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccttctcagatcatgtggt

SEQ ID NO: 62901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccttctcagatcatgtgg

SEQ ID NO: 62902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccttctcagatcatgtg

SEQ ID NO: 62903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatccttctcagatcatgt

SEQ ID NO: 62904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgatcatgtgatttttatc

SEQ ID NO: 62905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgatcatgtgattttta

SEQ ID NO: 62906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgatgatcatgtgattttt

SEQ ID NO: 62907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctgatgatcatgtgattt

SEQ ID NO: 62908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatctcttctgatgatcatg

SEQ ID NO: 62909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaatctcttctgatgatca

SEQ ID NO: 62910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaatctcttctgatgatc

SEQ ID NO: 62911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgaatctcttctgatga

SEQ ID NO: 62912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctgaatctcttctgatg

SEQ ID NO: 62913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaatgcttcttctgaatc

SEQ ID NO: 62914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaaatgcttcttctgaat

SEQ ID NO: 62915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatttgtcaaatgcttctt

SEQ ID NO: 62916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaaatttgtcaaatgctt

SEQ ID NO: 62917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatgaaaggttgttgaaat

SEQ ID NO: 62918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accatgaaaggttgttgaaa

SEQ ID NO: 62919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccatgaaaggttgttgaa

SEQ ID NO: 62920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaccatgaaaggttgttga

SEQ ID NO: 62921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttttaccatgaaaggttg

SEQ ID NO: 62922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttttaccatgaaaggtt

SEQ ID NO: 62923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtttttaccatgaaaggt

SEQ ID NO: 62924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtttttaccatgaaagg

SEQ ID NO: 62925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtttttaccatgaaag

SEQ ID NO: 62926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttagtttttaccatgaaa

SEQ ID NO: 62927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttagtttttaccatgaa

SEQ ID NO: 62928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttagtttttaccatg

SEQ ID NO: 62929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttttagtttttaccat

SEQ ID NO: 62930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttttagtttttacca

SEQ ID NO: 62931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctttttttagttttta

SEQ ID NO: 62932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttctttttttagttttt

SEQ ID NO: 62933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttctttttttagtttt

SEQ ID NO: 62934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttttctttttttagttt

SEQ ID NO: 62935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcttttgttttcttttttta

SEQ ID NO: 62936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacctagcttttgttttctt

SEQ ID NO: 62937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatacctagcttttgttttc

SEQ ID NO: 62938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatacctagcttttgtttt

SEQ ID NO: 62939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcaacttctatacctagc

SEQ ID NO: 62940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttatagcaacttctata

SEQ ID NO: 62941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagttatagcaacttctat

SEQ ID NO: 62942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggggacaaaccttcaagt

SEQ ID NO: 62943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggggacaaaccttcaag

SEQ ID NO: 62944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaggggacaaaccttcaa

SEQ ID NO: 62945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacatgagctttggagggg

SEQ ID NO: 62946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgcaacatgagctttgg

SEQ ID NO: 62947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattaaattgcaacatgag

SEQ ID NO: 62948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcacaattgcaattaaattg

SEQ ID NO: 62949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcacaattgcaattaaat

SEQ ID NO: 62950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaattctgtcacaattgca

SEQ ID NO: 62951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctcccaattctgtcacaa

SEQ ID NO: 62952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggtctcacctcccaattc

SEQ ID NO: 62953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaggtctcacctcccaatt

SEQ ID NO: 62954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaaggtctcacctcccaa

SEQ ID NO: 62955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacacctcttaaaggtctca

SEQ ID NO: 62956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacacctcttaaaggtctc

SEQ ID NO: 62957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataacttaaacacctcttaa

SEQ ID NO: 62958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcataacttaaacacctctt

SEQ ID NO: 62959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagggtaaaattctcataa

SEQ ID NO: 62960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagggtaaaattctcata

SEQ ID NO: 62961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcatttaaaagggtaaaa

SEQ ID NO: 62962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agataacagcattaatgcat

SEQ ID NO: 62963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatcctgagataacagcatt

SEQ ID NO: 62964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgaactcaatcctgaga

SEQ ID NO: 62965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatgaactcaatcctgag

SEQ ID NO: 62966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttataatgaactcaatcct

SEQ ID NO: 62967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgtttataatgaactcaa

SEQ ID NO: 62968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatacacatggcacaaaga

SEQ ID NO: 62969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaggtatcatgttatgata

SEQ ID NO: 62970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcataacatgctgtaagg

SEQ ID NO: 62971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtgtcataacatgctgta

SEQ ID NO: 62972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtgtcataacatgctgt

SEQ ID NO: 62973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgttgtgtcataacatgc

SEQ ID NO: 62974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttgttgtgtcataacatg

SEQ ID NO: 62975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgaggtcttatttgttgtg

SEQ ID NO: 62976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctggtgaggtcttatttgt

SEQ ID NO: 62977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggggctgtctggtgaggtc

SEQ ID NO: 62978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgactgaggggctgtctgg

SEQ ID NO: 62979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggatggaaagttcatgac

SEQ ID NO: 62980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgggatcacagtactggagg

SEQ ID NO: 62981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgggatcacagtactggag

SEQ ID NO: 62982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgaacataaaccttatg

SEQ ID NO: 62983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatgaacataaaccttat

SEQ ID NO: 62984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtaatttataatgaacata

SEQ ID NO: 62985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taacagaataccacagactg

SEQ ID NO: 62986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctataacagaataccacaga

SEQ ID NO: 62987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctactataacagaatacc

SEQ ID NO: 62988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgctactataacagaatac

SEQ ID NO: 62989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atccatttgtgctactataa

SEQ ID NO: 62990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatccatttgtgctactat

SEQ ID NO: 62991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctcatccatttgtgctac

SEQ ID NO: 62992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttctcatccatttgtgct

SEQ ID NO: 62993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctgttctcatccatttgt

SEQ ID NO: 62994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctgttctcatccatttg

SEQ ID NO: 62995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatgaagtatatttcctct

SEQ ID NO: 62996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatcatgaagtatatttcc

SEQ ID NO: 62997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatcatgaagtatatttc

SEQ ID NO: 62998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttatcatgaagtatattt

SEQ ID NO: 62999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtagtctttgttatcatg

SEQ ID NO: 63000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtagtctttgttatcat

SEQ ID NO: 63001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagtagtctttgttatca

SEQ ID NO: 63002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgggattttcaagtagtctt

SEQ ID NO: 63003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgtgggattttcaagtag

SEQ ID NO: 63004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatacgatgttagctgtggg

SEQ ID NO: 63005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accattgaatacgatgttag

SEQ ID NO: 63006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccattgaatacgatgtta

SEQ ID NO: 63007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaccattgaatacgatgtt

SEQ ID NO: 63008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaccattgaatacgatgt

SEQ ID NO: 63009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttttcaccattgaatac

SEQ ID NO: 63010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtttttcaccattgaata

SEQ ID NO: 63011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtttttcaccattgaat

SEQ ID NO: 63012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagtttttcaccattgaa

SEQ ID NO: 63013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggaaagtttttcagtttt

SEQ ID NO: 63014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaggaaagtttttcagttt

SEQ ID NO: 63015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcttacaggaaagtttttc

SEQ ID NO: 63016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatcttacaggaaagttt

SEQ ID NO: 63017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcctgatcttacaggaaag

SEQ ID NO: 63018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcctgatcttacaggaaa

SEQ ID NO: 63019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttattcctgatcttacag

SEQ ID NO: 63020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttattcctgatcttaca

SEQ ID NO: 63021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacaagtggcaagagtag

SEQ ID NO: 63022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttaaatacaagtggcaag

SEQ ID NO: 63023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgctgtgttaaatacaagt

SEQ ID NO: 63024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtgctgtgttaaatacaa

SEQ ID NO: 63025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctagtgctgtgttaaataca

SEQ ID NO: 63026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggacttctagtgctgtgtta

SEQ ID NO: 63027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaggacttctagtgctgt

SEQ ID NO: 63028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggctaggacttctagtgct

SEQ ID NO: 63029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggctaggacttctagtg

SEQ ID NO: 63030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctggctaggacttctagt

SEQ ID NO: 63031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctctggctaggacttc

SEQ ID NO: 63032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaatttctctggctagga

SEQ ID NO: 63033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctaatttctctggctagg

SEQ ID NO: 63034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgcctaatttctctggcta

SEQ ID NO: 63035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgcctaatttctctggct

SEQ ID NO: 63036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgcctaatttctctggc

SEQ ID NO: 63037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgcctaatttctctgg

SEQ ID NO: 63038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttcttgcctaatttctc

SEQ ID NO: 63039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttcttgcctaatttct

SEQ ID NO: 63040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgtttttcttgcctaatt

SEQ ID NO: 63041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttgtttttcttgcctaat

SEQ ID NO: 63042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttgtttttcttgcctaa

SEQ ID NO: 63043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacttgtttttcttgccta

SEQ ID NO: 63044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatgtcttttacttgtttt

SEQ ID NO: 63045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattgggatgtcttttact

SEQ ID NO: 63046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagattgggatgtcttttac

SEQ ID NO: 63047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagattgggatgtctttta

SEQ ID NO: 63048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcagattgggatgtcttt

SEQ ID NO: 63049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcagattgggatgtctt

SEQ ID NO: 63050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcagattgggatgtct

SEQ ID NO: 63051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttcagattgggatgtc

SEQ ID NO: 63052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttcagattgggatgt

SEQ ID NO: 63053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctttcagattgggatg

SEQ ID NO: 63054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaacacttttttctttcag

SEQ ID NO: 63055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catataaaataatgtcatct

SEQ ID NO: 63056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccatataaaataatgtcat

SEQ ID NO: 63057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtactctccatataaaat

SEQ ID NO: 63058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggtactctccatataaaa

SEQ ID NO: 63059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagggtactctccatataaa

SEQ ID NO: 63060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtgtggagtctttagggt

SEQ ID NO: 63061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatgtgtggagtctttag

SEQ ID NO: 63062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgatgtgtggagtcttta

SEQ ID NO: 63063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgatgtgtggagtcttt

SEQ ID NO: 63064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagattttcctgatgtgtg

SEQ ID NO: 63065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacagattttcctgatgtg

SEQ ID NO: 63066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttctaacagattttcctga

SEQ ID NO: 63067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagttctaacagattttcc

SEQ ID NO: 63068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagttctaacagattttc

SEQ ID NO: 63069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttattagttctaacagatt

SEQ ID NO: 63070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttattagttctaacagat

SEQ ID NO: 63071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaaatttgtttattagttc

SEQ ID NO: 63072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacatctagtaaatttgttt

SEQ ID NO: 63073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacatctagtaaatttgtt

SEQ ID NO: 63074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatccttcaacatctagtaa

SEQ ID NO: 63075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatccttcaacatctagta

SEQ ID NO: 63076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatccttcaacatctagt

SEQ ID NO: 63077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttatatccttcaacatc

SEQ ID NO: 63078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgttgattttatatcctt

SEQ ID NO: 63079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatgttgattttatatcct

SEQ ID NO: 63080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatgttgattttatatcc

SEQ ID NO: 63081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatgttgattttatatc

SEQ ID NO: 63082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtatagaaacgcaggtga

SEQ ID NO: 63083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagtgtatagaaacgcagg

SEQ ID NO: 63084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgttagtgtatagaaacgc

SEQ ID NO: 63085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgttagtgtatagaaacg

SEQ ID NO: 63086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttattgttagtgtatagaa

SEQ ID NO: 63087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattgtttattgttagtgt

SEQ ID NO: 63088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagattgtttattgttagtg

SEQ ID NO: 63089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcagattgtttattgttag

SEQ ID NO: 63090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcagattgtttattgtt

SEQ ID NO: 63091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttcagattgtttattgt

SEQ ID NO: 63092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcttcagattgtttattg

SEQ ID NO: 63093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttctcttcagattgttt

SEQ ID NO: 63094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaattttctcttcagattg

SEQ ID NO: 63095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaattttctcttcagatt

SEQ ID NO: 63096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctaattttctcttcagat

SEQ ID NO: 63097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcctaattttctcttcag

SEQ ID NO: 63098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcctaattttctcttca

SEQ ID NO: 63099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcataaatgggatttctttc

SEQ ID NO: 63100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttatcataaatgggatt

SEQ ID NO: 63101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgttatcataaatgggat

SEQ ID NO: 63102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatgttatcataaatggga

SEQ ID NO: 63103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgatgttatcataaatggg

SEQ ID NO: 63104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgatgttatcataaatg

SEQ ID NO: 63105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgatgttatcataaat

SEQ ID NO: 63106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttttgatgttatcata

SEQ ID NO: 63107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcttttgatgttatcat

SEQ ID NO: 63108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcttttgatgttatca

SEQ ID NO: 63109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtattttatttcttttgat

SEQ ID NO: 63110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcatatcctaagtatttta

SEQ ID NO: 63111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaagcatatcctaagtat

SEQ ID NO: 63112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttaagcatatcctaagta

SEQ ID NO: 63113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgccttggttaagcatat

SEQ ID NO: 63114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgccttggttaagcata

SEQ ID NO: 63115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgccttggttaagcat

SEQ ID NO: 63116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgcatacattttcaatgc

SEQ ID NO: 63117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgcatacattttcaatg

SEQ ID NO: 63118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtgcatacattttcaat

SEQ ID NO: 63119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttttcagtgcatacatt

SEQ ID NO: 63120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttttcagtgcatacat

SEQ ID NO: 63121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagttttcagtgcataca

SEQ ID NO: 63122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaacattttgtagttttc

SEQ ID NO: 63123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgaacattttgtagtttt

SEQ ID NO: 63124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcatgaacattttgtagt

SEQ ID NO: 63125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttcatgaacattttgtag

SEQ ID NO: 63126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttccttcatgaacatttt

SEQ ID NO: 63127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttccttcatgaacattt

SEQ ID NO: 63128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatttccttcatgaacatt

SEQ ID NO: 63129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaatttccttcatgaaca

SEQ ID NO: 63130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttaatttccttcatgaac

SEQ ID NO: 63131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcttctttaatttccttc

SEQ ID NO: 63132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcttctttaatttcctt

SEQ ID NO: 63133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtgtcttctttaatttc

SEQ ID NO: 63134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtgtcttctttaattt

SEQ ID NO: 63135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttatttgtgtcttcttt

SEQ ID NO: 63136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttatttgtgtcttctt

SEQ ID NO: 63137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccatttatttgtgtcttct

SEQ ID NO: 63138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtctttccatttatttgtg

SEQ ID NO: 63139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgaatactgggtctttcca

SEQ ID NO: 63140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcgtgaatactgggtctt

SEQ ID NO: 63141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattcgtgaatactgggtct

SEQ ID NO: 63142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcatttaattcgtgaata

SEQ ID NO: 63143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaatattaagtcatttaat

SEQ ID NO: 63144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaatattaagtcatttaa

SEQ ID NO: 63145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacaatattaagtcattta

SEQ ID NO: 63146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtagtatgggcattttaa

SEQ ID NO: 63147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggtagtatgggcatttta

SEQ ID NO: 63148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagatcacttagggtagta

SEQ ID NO: 63149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcacagatcacttaggg

SEQ ID NO: 63150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattgaattcacagatcact

SEQ ID NO: 63151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatgtactgtattgaattc

SEQ ID NO: 63152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatgtactgtattgaatt

SEQ ID NO: 63153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatatgtactgtattgaat

SEQ ID NO: 63154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattttgatatgtactgta

SEQ ID NO: 63155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgggattttgatatgtact

SEQ ID NO: 63156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaataatgctattgggat

SEQ ID NO: 63157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaaataatgctattggga

SEQ ID NO: 63158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtaaataatgctattggg

SEQ ID NO: 63159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttagtaaataatgctatt

SEQ ID NO: 63160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttagtaaataatgctat

SEQ ID NO: 63161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttagtaaataatgcta

SEQ ID NO: 63162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttagtaaataatgct

SEQ ID NO: 63163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttagtaaataatgc

SEQ ID NO: 63164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttattttagtaaataatg

SEQ ID NO: 63165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttattttagtaaataat

SEQ ID NO: 63166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatctttttttattttagt

SEQ ID NO: 63167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggatctttttttattttag

SEQ ID NO: 63168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggatctttttttatttta

SEQ ID NO: 63169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatgaattttaggatctt

SEQ ID NO: 63170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttccatatgaattttag

SEQ ID NO: 63171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggttccatatgaatttta

SEQ ID NO: 63172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggttccatatgaatttt

SEQ ID NO: 63173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtggttccatatgaattt

SEQ ID NO: 63174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagtcttttgtggttccat

SEQ ID NO: 63175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagagtcttttgtggttc

SEQ ID NO: 63176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctattcagagtcttttgtg

SEQ ID NO: 63177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctattcagagtcttttgt

SEQ ID NO: 63178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggctattcagagtcttttg

SEQ ID NO: 63179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttggctattcagagtctt

SEQ ID NO: 63180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattgctttggctattcag

SEQ ID NO: 63181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagattgctttggctattca

SEQ ID NO: 63182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagattgctttggctatt

SEQ ID NO: 63183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaagattgctttggctat

SEQ ID NO: 63184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaagattgctttggcta

SEQ ID NO: 63185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttaagattgctttggct

SEQ ID NO: 63186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttaagattgctttggc

SEQ ID NO: 63187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcttaagattgctttgg

SEQ ID NO: 63188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttcttaagattgcttt

SEQ ID NO: 63189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttttttcttaagattgc

SEQ ID NO: 63190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcttttttcttaagattg

SEQ ID NO: 63191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttcttttttcttaagatt

SEQ ID NO: 63192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattttgttcttttttctta

SEQ ID NO: 63193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccattttgttcttttttctt

SEQ ID NO: 63194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccattttgttcttttttc

SEQ ID NO: 63195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aataaataaataaataagaa

SEQ ID NO: 63196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaataaataaataaataag

SEQ ID NO: 63197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcaataaataaataaata

SEQ ID NO: 63198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctcaataaataaataaa

SEQ ID NO: 63199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctctcaataaataaataa

SEQ ID NO: 63200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaacagggtgagatcttc

SEQ ID NO: 63201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctgggcaacagggtgaga

SEQ ID NO: 63202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggcctgggcaacagggtga

SEQ ID NO: 63203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactctggcctgggcaacag

SEQ ID NO: 63204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatcatgccactgcactct

SEQ ID NO: 63205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtgagctatgatcatgcc

SEQ ID NO: 63206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagcccaagagtatgaggct

SEQ ID NO: 63207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgggaggatcactgaag

SEQ ID NO: 63208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagcctgaggtgggaggat

SEQ ID NO: 63209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggagcctgaggtgggagga

SEQ ID NO: 63210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttaggagcctgaggtggga

SEQ ID NO: 63211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctacttaggagcctgaggt

SEQ ID NO: 63212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtcctagctacttaggag

SEQ ID NO: 63213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagtagccaagcatgatg

SEQ ID NO: 63214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaagtagccaagcatgat

SEQ ID NO: 63215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgaagatatttgaaaagtag

SEQ ID NO: 63216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgaagatatttgaaaagta

SEQ ID NO: 63217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacgaagatatttgaaaagt

SEQ ID NO: 63218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacgaagatatttgaaaa

SEQ ID NO: 63219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttacgaagatatttgaaa

SEQ ID NO: 63220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttctttacgaagatatttg

SEQ ID NO: 63221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaagatagactccttctt

SEQ ID NO: 63222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaccagcctgggcaagata

SEQ ID NO: 63223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaccagcctgggcaagat

SEQ ID NO: 63224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggccaagagtttgagacca

SEQ ID NO: 63225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtggccaagagtttgagacc

SEQ ID NO: 63226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggatcacttgtggccaag

SEQ ID NO: 63227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggctggaggatcacttgtg

SEQ ID NO: 63228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggaggctaaggctggagga

SEQ ID NO: 63229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatcccagcaactcgggag

SEQ ID NO: 63230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatcccagcaactcggga

SEQ ID NO: 63231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcttataatcccagcaac

SEQ ID NO: 63232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgcaatggctcatgctta

SEQ ID NO: 63233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggggactgggtgcaatggc

SEQ ID NO: 63234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgaggacctgtggggac

SEQ ID NO: 63235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatgaggacctgtgggga

SEQ ID NO: 63236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaatgaggacctgtgggg

SEQ ID NO: 63237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacattttgaaatgaggacc

SEQ ID NO: 63238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatacattttgaaatgagg

SEQ ID NO: 63239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatacattttgaaatgag

SEQ ID NO: 63240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttatacattttgaaatga

SEQ ID NO: 63241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagctttgttatacattttg

SEQ ID NO: 63242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtagctttgttatacatt

SEQ ID NO: 63243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgttgtagctttgttata

SEQ ID NO: 63244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgttgtagctttgttat

SEQ ID NO: 63245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattgttgtagctttgtta

SEQ ID NO: 63246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaattgttgtagctttg

SEQ ID NO: 63247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgccaggaccatactatttt

SEQ ID NO: 63248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgccaggaccatactattt

SEQ ID NO: 63249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgccaggaccatactatt

SEQ ID NO: 63250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttatgccaggaccatact

SEQ ID NO: 63251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttatgccaggaccatac

SEQ ID NO: 63252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatttgttttatgccagg

SEQ ID NO: 63253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctatatatttgttttatg

SEQ ID NO: 63254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggcctatatatttgttt

SEQ ID NO: 63255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattggcctatatatttgtt

SEQ ID NO: 63256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcattggcctatatattt

SEQ ID NO: 63257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcctgtttcattggcctata

SEQ ID NO: 63258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatcctgtttcattggccta

SEQ ID NO: 63259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctatcctgtttcattggcc

SEQ ID NO: 63260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctctctatcctgtttcat

SEQ ID NO: 63261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggctctctatcctgtttc

SEQ ID NO: 63262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggctctctatcctgttt

SEQ ID NO: 63263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgggctctctatcctg

SEQ ID NO: 63264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctgggctctctatcct

SEQ ID NO: 63265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcatgggtttatttctggg

SEQ ID NO: 63266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcatgggtttatttctgg

SEQ ID NO: 63267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatgcatgggtttatttc

SEQ ID NO: 63268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actatttatgcatgggttta

SEQ ID NO: 63269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatgagttaactatttat

SEQ ID NO: 63270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaatatgagttaactatt

SEQ ID NO: 63271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacccctgttgaatatgag

SEQ ID NO: 63272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcacccctgttgaatatga

SEQ ID NO: 63273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcacccctgttgaatat

SEQ ID NO: 63274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtattcttggcacccctgt

SEQ ID NO: 63275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgtattcttggcacccc

SEQ ID NO: 63276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgtgtattcttggcacc

SEQ ID NO: 63277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattgtgtattcttggcac

SEQ ID NO: 63278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattgtgtattcttggca

SEQ ID NO: 63279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctattgtgtattcttggc

SEQ ID NO: 63280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttctattgtgtattcttg

SEQ ID NO: 63281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtggcctcttttctattgt

SEQ ID NO: 63282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgagtggcctcttttctat

SEQ ID NO: 63283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgagtggcctcttttcta

SEQ ID NO: 63284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgttgagtggcctctttt

SEQ ID NO: 63285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaacattatttgttgagtg

SEQ ID NO: 63286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaacattatttgttgagt

SEQ ID NO: 63287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccaacattatttgttgag

SEQ ID NO: 63288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtgaatatccagttttc

SEQ ID NO: 63289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgtgaatatccagtttt

SEQ ID NO: 63290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgtgaatatccagttt

SEQ ID NO: 63291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatgtgaatatccagtt

SEQ ID NO: 63292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatatgtgaatatccagt

SEQ ID NO: 63293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatatgtgaatatccag

SEQ ID NO: 63294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttatatgtgaatatc

SEQ ID NO: 63295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttatatgtgaatat

SEQ ID NO: 63296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttttatatgtgaata

SEQ ID NO: 63297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttatttttttatatgt

SEQ ID NO: 63298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtatggtataatataagaa

SEQ ID NO: 63299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtatggtataatataaga

SEQ ID NO: 63300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtatggtataatataag

SEQ ID NO: 63301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtatggtataatataa

SEQ ID NO: 63302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgtgtatggtataata

SEQ ID NO: 63303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttgtgtatggtataat

SEQ ID NO: 63304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtttatttttgtgtatggt

SEQ ID NO: 63305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtttatttttgtgtatgg

SEQ ID NO: 63306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagtttatttttgtgtatg

SEQ ID NO: 63307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgagtttatttttgtgt

SEQ ID NO: 63308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctattttgagtttatttt

SEQ ID NO: 63309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctattttgagtttattt

SEQ ID NO: 63310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtttaatctattttgag

SEQ ID NO: 63311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtttaatctattttga

SEQ ID NO: 63312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtttaaatgtttaatctat

SEQ ID NO: 63313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtttaaatgtttaatcta

SEQ ID NO: 63314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtcttaggtttaaatgtt

SEQ ID NO: 63315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggtcttaggtttaaatgt

SEQ ID NO: 63316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggtcttaggtttaaatg

SEQ ID NO: 63317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagttttcaggtcttaggtt

SEQ ID NO: 63318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagttttcaggtcttaggt

SEQ ID NO: 63319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagttttcaggtcttagg

SEQ ID NO: 63320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagttttacagttttcagg

SEQ ID NO: 63321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaagttttacagttttca

SEQ ID NO: 63322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctacaagttttacagttttc

SEQ ID NO: 63323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctacaagttttacagttt

SEQ ID NO: 63324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctacaagttttacagtt

SEQ ID NO: 63325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctacaagttttacagt

SEQ ID NO: 63326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttttcttctacaagtttt

SEQ ID NO: 63327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatgttttcttctacaagt

SEQ ID NO: 63328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctatgttttcttctaca

SEQ ID NO: 63329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctatgttttcttctac

SEQ ID NO: 63330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctgctatgttttcttcta

SEQ ID NO: 63331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaagaacagtatcatgaag

SEQ ID NO: 63332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaagaaatcattgtcaaga

SEQ ID NO: 63333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagtcattgccaagaaatca

SEQ ID NO: 63334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagtcattgccaagaaatc

SEQ ID NO: 63335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggagtcattgccaagaaat

SEQ ID NO: 63336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttggagtcattgccaa

SEQ ID NO: 63337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattttggagtcattgcca

SEQ ID NO: 63338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgaattttggagtcattg

SEQ ID NO: 63339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgaattttggagtcatt

SEQ ID NO: 63340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtttgaattttggagtca

SEQ ID NO: 63341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcttgtttgaattttggag

SEQ ID NO: 63342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcttgtttgaattttgga

SEQ ID NO: 63343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctcttgtttgaattttgg

SEQ ID NO: 63344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctcttgtttgaattttg

SEQ ID NO: 63345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttgctcttgtttgaatt

SEQ ID NO: 63346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctatttttgctcttgtttg

SEQ ID NO: 63347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattgtctatttttgctctt

SEQ ID NO: 63348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatggtctcaattgtctat

SEQ ID NO: 63349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatggtctcaattgtcta

SEQ ID NO: 63350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttgatatggtctcaattg

SEQ ID NO: 63351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttgatatggtctcaatt

SEQ ID NO: 63352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtttgatatggtctcaat

SEQ ID NO: 63353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtttgatatggtctcaa

SEQ ID NO: 63354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagtttgatatggtctca

SEQ ID NO: 63355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaagctttttagtttgat

SEQ ID NO: 63356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaaagctttttagtttga

SEQ ID NO: 63357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccaaagctttttagtttg

SEQ ID NO: 63358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccaaagctttttagttt

SEQ ID NO: 63359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcccaaagctttttagtt

SEQ ID NO: 63360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcccaaagctttttagt

SEQ ID NO: 63361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttcccaaagctttttag

SEQ ID NO: 63362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttttcccaaagctttt

SEQ ID NO: 63363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttttttcccaaagcttt

SEQ ID NO: 63364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgcttcctttttttccca

SEQ ID NO: 63365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatgcttcctttttttccc

SEQ ID NO: 63366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgaatgcttcctttttttc

SEQ ID NO: 63367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accctcttgaatgcttcctt

SEQ ID NO: 63368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccctcttgaatgcttcct

SEQ ID NO: 63369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaccctcttgaatgcttcc

SEQ ID NO: 63370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaccctcttgaatgcttc

SEQ ID NO: 63371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcaccctcttgaatgctt

SEQ ID NO: 63372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttttcaccctcttgaatg

SEQ ID NO: 63373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggttgctttttcaccctc

SEQ ID NO: 63374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataggttgctttttcaccc

SEQ ID NO: 63375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattctataggttgctttt

SEQ ID NO: 63376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccattctataggttgctt

SEQ ID NO: 63377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccattctataggttgct

SEQ ID NO: 63378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccattctataggttgc

SEQ ID NO: 63379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaatattttctcccattct

SEQ ID NO: 63380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatatatagttggaaatatt

SEQ ID NO: 63381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagatatatagttggaaat

SEQ ID NO: 63382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagatatatagttggaaa

SEQ ID NO: 63383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatttattagatatatag

SEQ ID NO: 63384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatattaaccatttattaga

SEQ ID NO: 63385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatattaaccatttattag

SEQ ID NO: 63386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggatattaaccatttatta

SEQ ID NO: 63387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatattttggatattaacca

SEQ ID NO: 63388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctatatattttggatatta

SEQ ID NO: 63389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caggagttccctatatattt

SEQ ID NO: 63390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttgcaggagttccctata

SEQ ID NO: 63391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagttgcaggagttccctat

SEQ ID NO: 63392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagttgcaggagttccct

SEQ ID NO: 63393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaagttgcaggagttccc

SEQ ID NO: 63394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgccttcttaagttgcag

SEQ ID NO: 63395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgccttcttaagttgca

SEQ ID NO: 63396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcatttgcatgccttctta

SEQ ID NO: 63397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatacatgttggtcatttg

SEQ ID NO: 63398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatacatgttggtcattt

SEQ ID NO: 63399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatatacatgttggtcatt

SEQ ID NO: 63400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaatatacatgttggtcat

SEQ ID NO: 63401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcatcttttaatatacatg

SEQ ID NO: 63402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgatactgagcatctttta

SEQ ID NO: 63403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgattagtgatactgagca

SEQ ID NO: 63404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgattagtgatactgag

SEQ ID NO: 63405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatgattagtgatactga

SEQ ID NO: 63406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgatgattagtgatactg

SEQ ID NO: 63407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttctgatgattagtga

SEQ ID NO: 63408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattttctgatgattagtg

SEQ ID NO: 63409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaattttctgatgatta

SEQ ID NO: 63410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgaattttctgatgatt

SEQ ID NO: 63411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgaattttctgatgat

SEQ ID NO: 63412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttgaattttctgatga

SEQ ID NO: 63413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtttttatttgaattttc

SEQ ID NO: 63414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attacagtttttatttgaat

SEQ ID NO: 63415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccctcattacagtttttat

SEQ ID NO: 63416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacctggccctcattacagt

SEQ ID NO: 63417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggataacaggcatgagccac

SEQ ID NO: 63418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctgggataacag

SEQ ID NO: 63419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctcccaaagtgctgggat

SEQ ID NO: 63420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcctcccaaagtgctggga

SEQ ID NO: 63421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgatccacccaccttggcc

SEQ ID NO: 63422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcatgatccacccacct

SEQ ID NO: 63423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcatgatccaccca

SEQ ID NO: 63424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctcctgacctcatgatcc

SEQ ID NO: 63425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatctcctgacctcatgatc

SEQ ID NO: 63426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaggatggtcttgatctc

SEQ ID NO: 63427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccaggatggtcttgatct

SEQ ID NO: 63428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggccaggatggtcttgatc

SEQ ID NO: 63429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accattttggccaggatggt

SEQ ID NO: 63430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccattttggccaggatgg

SEQ ID NO: 63431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtagagatggagtttcacc

SEQ ID NO: 63432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtagagatggagtttcac

SEQ ID NO: 63433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtagagatggagtttca

SEQ ID NO: 63434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattttcagtagagatggag

SEQ ID NO: 63435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattttcagtagagatgga

SEQ ID NO: 63436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattttcagtagagatgg

SEQ ID NO: 63437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtattttcagtagagatg

SEQ ID NO: 63438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttgtattttcagtaga

SEQ ID NO: 63439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcatgtgccaccatgcc

SEQ ID NO: 63440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggcatgtgccac

SEQ ID NO: 63441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaagtagctgggattacag

SEQ ID NO: 63442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccaagtagctgggattaca

SEQ ID NO: 63443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcttcccaagtagctggga

SEQ ID NO: 63444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcttcccaagtagct

SEQ ID NO: 63445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcttcccaagta

SEQ ID NO: 63446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcttcccaag

SEQ ID NO: 63447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgattctcctgcctcag

SEQ ID NO: 63448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttcaagtgattctcctgcc

SEQ ID NO: 63449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctggttcaagtgattctcc

SEQ ID NO: 63450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgactccctggttcaagtga

SEQ ID NO: 63451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacctccgactccctggtt

SEQ ID NO: 63452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaacctccgactccct

SEQ ID NO: 63453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctcactgcaacctccgac

SEQ ID NO: 63454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggcgcgatctc

SEQ ID NO: 63455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaccaggctggagtgcagt

SEQ ID NO: 63456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcaccaggctggagtgca

SEQ ID NO: 63457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctgtcaccaggctggag

SEQ ID NO: 63458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggagtctcactctgtcac

SEQ ID NO: 63459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggagtctcactctgtca

SEQ ID NO: 63460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaggagtctcactctgtc

SEQ ID NO: 63461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaggagtctcactctgt

SEQ ID NO: 63462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgaaggagtctcactc

SEQ ID NO: 63463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttgaaggagtctcact

SEQ ID NO: 63464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttttgaaggagtctc

SEQ ID NO: 63465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttttgaaggagtct

SEQ ID NO: 63466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttgtttttgaaggag

SEQ ID NO: 63467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttgtttttgaagga

SEQ ID NO: 63468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgtttgtttgtttttgaa

SEQ ID NO: 63469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtttgtttgtttgttttt

SEQ ID NO: 63470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgctgtttgtttgtttgtt

SEQ ID NO: 63471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgctgtttgtttgtttgt

SEQ ID NO: 63472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcgtgagccaccacgcc

SEQ ID NO: 63473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggcgtgagccac

SEQ ID NO: 63474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctgggattacag

SEQ ID NO: 63475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggcctcccaaagtgctggga

SEQ ID NO: 63476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtgatccgcccgtctcggcc

SEQ ID NO: 63477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcgtgatccgcccgtct

SEQ ID NO: 63478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcgtgatccgcccg

SEQ ID NO: 63479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gatctcctgacctcgtgatc

SEQ ID NO: 63480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaggatggtctcgatctc

SEQ ID NO: 63481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagccaggatggtctcgat

SEQ ID NO: 63482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accctgttagccaggatggt

SEQ ID NO: 63483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccctgttagccaggatgg

SEQ ID NO: 63484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacggggtttcaccc

SEQ ID NO: 63485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacggggtttcacc

SEQ ID NO: 63486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacggggtttcac

SEQ ID NO: 63487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacggggtttca

SEQ ID NO: 63488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacgggg

SEQ ID NO: 63489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacggg

SEQ ID NO: 63490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacgg

SEQ ID NO: 63491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatttttagtagagacg

SEQ ID NO: 63492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttgtatttttagtaga

SEQ ID NO: 63493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggcgtgcgccaccatgcc

SEQ ID NO: 63494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactacaggcgtgcgccac

SEQ ID NO: 63495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgtgtagctgggactacag

SEQ ID NO: 63496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcccgtgtagctggga

SEQ ID NO: 63497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcccgtgtagct

SEQ ID NO: 63498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctcccgtgta

SEQ ID NO: 63499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctcccgtg

SEQ ID NO: 63500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgccattctcctgcctcag

SEQ ID NO: 63501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgggttcacgccattctcc

SEQ ID NO: 63502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcctcccgggttcacgcca

SEQ ID NO: 63503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagctccgcctcccgggtt

SEQ ID NO: 63504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaagctccgcctcccg

SEQ ID NO: 63505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gactcactgcaagctccgcc

SEQ ID NO: 63506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggcgcgatctc

SEQ ID NO: 63507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcgcccaggctggagtgcag

SEQ ID NO: 63508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcgcccaggctggagtgc

SEQ ID NO: 63509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctctgtcgcccaggctgga

SEQ ID NO: 63510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgctctgtcgcccaggctgg

SEQ ID NO: 63511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacggagtttcgctctgtc

SEQ ID NO: 63512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacggagtttcgctctgt

SEQ ID NO: 63513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacggagtttcgctctg

SEQ ID NO: 63514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagacggagtttcgctct

SEQ ID NO: 63515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagacggagtttcgctc

SEQ ID NO: 63516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagacggagtttcgct

SEQ ID NO: 63517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagacggagtttcgc

SEQ ID NO: 63518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagacggagtttcg

SEQ ID NO: 63519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagacggagtttc

SEQ ID NO: 63520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagacggagttt

SEQ ID NO: 63521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttttttttgagacggag

SEQ ID NO: 63522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtttttttttttgagacg

SEQ ID NO: 63523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtttttttttttgagac

SEQ ID NO: 63524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgtttttttttttgaga

SEQ ID NO: 63525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgtttttttttttgag

SEQ ID NO: 63526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttgtttttttttttga

SEQ ID NO: 63527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgttgtttttttttttg

SEQ ID NO: 63528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgttgttttttttttt

SEQ ID NO: 63529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgttgtttttttttt

SEQ ID NO: 63530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgttgttttttttt

SEQ ID NO: 63531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgttgtttttttt

SEQ ID NO: 63532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgttgttttttt

SEQ ID NO: 63533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgttgtttttt

SEQ ID NO: 63534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgttgttttt

SEQ ID NO: 63535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgttgtttt

SEQ ID NO: 63536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgttgttt

SEQ ID NO: 63537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttgttgtt

SEQ ID NO: 63538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttgttgt

SEQ ID NO: 63539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttgttg

SEQ ID NO: 63540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttgtt

SEQ ID NO: 63541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttttttgt

SEQ ID NO: 63542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttg

SEQ ID NO: 63543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 63544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 63545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 63546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 63547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttttttttt

SEQ ID NO: 63548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttttttttttttttttt

SEQ ID NO: 63549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgttttttttttttttttt

SEQ ID NO: 63550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgctgtttttttttttttt

SEQ ID NO: 63551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgctgttttttttttttt

SEQ ID NO: 63552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgctgtttttttttttt

SEQ ID NO: 63553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgctgttttttttttt

SEQ ID NO: 63554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttgctgtttttttttt

SEQ ID NO: 63555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cggttttttgttgctgtttt

SEQ ID NO: 63556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acggttttttgttgctgttt

SEQ ID NO: 63557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacggttttttgttgctgtt

SEQ ID NO: 63558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttacggttttttgttgctg

SEQ ID NO: 63559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaggtatgaaatgatatct

SEQ ID NO: 63560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaatagccatcctagcagg

SEQ ID NO: 63561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaatagccatcctagcag

SEQ ID NO: 63562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaatagccatcctagca

SEQ ID NO: 63563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttggtaatagccatccta

SEQ ID NO: 63564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttggtaatagccatcct

SEQ ID NO: 63565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttggtaatagccatcc

SEQ ID NO: 63566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttttggtaatagccatc

SEQ ID NO: 63567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgttttggtaatagcc

SEQ ID NO: 63568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttgttttggtaatagc

SEQ ID NO: 63569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttttgttttggtaatag

SEQ ID NO: 63570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttttgttttggtaata

SEQ ID NO: 63571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtggtttttgtttttgttt

SEQ ID NO: 63572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtggtttttgtttttgtt

SEQ ID NO: 63573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgggtggtttttgtttt

SEQ ID NO: 63574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgggtggtttttgttt

SEQ ID NO: 63575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgggtggtttttgtt

SEQ ID NO: 63576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgatttgggtggtttttgt

SEQ ID NO: 63577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttttgatttgggtggttt

SEQ ID NO: 63578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatcttttgatttgggtgg

SEQ ID NO: 63579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaacacctattatcttttg

SEQ ID NO: 63580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaacacctattatctttt

SEQ ID NO: 63581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catatccttgccaacaccta

SEQ ID NO: 63582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatatccttgccaacacc

SEQ ID NO: 63583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccatatccttgccaacac

SEQ ID NO: 63584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctccatatccttgcca

SEQ ID NO: 63585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttctccatatccttgc

SEQ ID NO: 63586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caacaatgtacaaaggttct

SEQ ID NO: 63587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattccaacaatgtacaaag

SEQ ID NO: 63588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattccaacaatgtacaaa

SEQ ID NO: 63589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattccaacaatgtacaa

SEQ ID NO: 63590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catcattttacattccaaca

SEQ ID NO: 63591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggcagctacatcattttac

SEQ ID NO: 63592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatggcagctacatcatttt

SEQ ID NO: 63593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatggcagctacatcattt

SEQ ID NO: 63594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatggcagctacatcatt

SEQ ID NO: 63595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttctatggcagctacatc

SEQ ID NO: 63596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactgttttctatggcagc

SEQ ID NO: 63597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catactgttttctatggcag

SEQ ID NO: 63598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatactgttttctatggca

SEQ ID NO: 63599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaactttcatactgtttt

SEQ ID NO: 63600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggaactttcatactgttt

SEQ ID NO: 63601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaggaactttcatactgtt

SEQ ID NO: 63602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaggaactttcatactgt

SEQ ID NO: 63603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaggaactttcatactg

SEQ ID NO: 63604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttttcaggaactttcat

SEQ ID NO: 63605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttttcaggaactttca

SEQ ID NO: 63606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattttttcaggaactttc

SEQ ID NO: 63607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattttttcaggaacttt

SEQ ID NO: 63608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttttaattttttcagga

SEQ ID NO: 63609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatcaaatggtagttatatt

SEQ ID NO: 63610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctagatcaaatggtagttat

SEQ ID NO: 63611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatgtggcattgctagatc

SEQ ID NO: 63612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatgctcagatgtggca

SEQ ID NO: 63613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatatgctcagatgtggc

SEQ ID NO: 63614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatatgctcagatgtgg

SEQ ID NO: 63615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaatatgctcagatgtg

SEQ ID NO: 63616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttttaaaatatgctca

SEQ ID NO: 63617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttcaaatttttaaaatat

SEQ ID NO: 63618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatcctgagttcaaatttt

SEQ ID NO: 63619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgagatcctgagttcaaatt

SEQ ID NO: 63620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtgaacatggaagtaagg

SEQ ID NO: 63621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatacagtaaatagtgctga

SEQ ID NO: 63622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatacagtaaatagtgctg

SEQ ID NO: 63623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatttggatacagtaaata

SEQ ID NO: 63624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatttggatacagtaaat

SEQ ID NO: 63625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatttggatacagtaaa

SEQ ID NO: 63626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcatatttggatacagt

SEQ ID NO: 63627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttgttttcatatttggat

SEQ ID NO: 63628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggttgttttcatatttgga

SEQ ID NO: 63629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaatagacatttaggttg

SEQ ID NO: 63630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcccatcattcatcaataga

SEQ ID NO: 63631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcccatcattcatcaata

SEQ ID NO: 63632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatcccatcattcatcaat

SEQ ID NO: 63633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatcccatcattcatcaa

SEQ ID NO: 63634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtgtgtgtgtacgtgca

SEQ ID NO: 63635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgtgtgtgtgtacgtgc

SEQ ID NO: 63636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatagtgtgtgtttgtgtgt

SEQ ID NO: 63637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggctgaatagtgtgtgt

SEQ ID NO: 63638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaggctgaatagtgtgtg

SEQ ID NO: 63639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaggctgaatagtgtgt

SEQ ID NO: 63640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttataaggctgaatagtgt

SEQ ID NO: 63641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttataaggctgaatagtg

SEQ ID NO: 63642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctttataaggctgaata

SEQ ID NO: 63643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctttataaggctgaat

SEQ ID NO: 63644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatggcaggatttccttc

SEQ ID NO: 63645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcatatggcaggatttcc

SEQ ID NO: 63646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttgctgcatatggcagg

SEQ ID NO: 63647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcaagttgctgcatatgg

SEQ ID NO: 63648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaggttcattcaagttgc

SEQ ID NO: 63649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccaggttcattcaagttg

SEQ ID NO: 63650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcataaatttatccaggtt

SEQ ID NO: 63651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcagcataaatttatcca

SEQ ID NO: 63652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactcagcataaatttatcc

SEQ ID NO: 63653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcactcagcataaattta

SEQ ID NO: 63654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttacttcactcagcataaat

SEQ ID NO: 63655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttacttcactcagcataa

SEQ ID NO: 63656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttacttcactcagcata

SEQ ID NO: 63657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgttacttcactcagcat

SEQ ID NO: 63658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgttacttcactcagca

SEQ ID NO: 63659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctgttacttcactcagc

SEQ ID NO: 63660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaatattttttctgttac

SEQ ID NO: 63661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accgaagtggaattatgcaa

SEQ ID NO: 63662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccgaagtggaattatgca

SEQ ID NO: 63663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcaccgaagtggaattat

SEQ ID NO: 63664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttacttcaccgaagtggaa

SEQ ID NO: 63665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttacttcaccgaagtgga

SEQ ID NO: 63666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttacttcaccgaagtgg

SEQ ID NO: 63667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accattttagttacttcacc

SEQ ID NO: 63668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaccattttagttacttcac

SEQ ID NO: 63669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgagtttgaccattttag

SEQ ID NO: 63670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgagtttgaccatttta

SEQ ID NO: 63671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttccatgagtttgaccatt

SEQ ID NO: 63672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttccatgagtttgacca

SEQ ID NO: 63673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgtttccatgagtttgac

SEQ ID NO: 63674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctgtttccatgagtttg

SEQ ID NO: 63675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctctgtttccatgagttt

SEQ ID NO: 63676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctctctgtttccatgagt

SEQ ID NO: 63677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaatcaccattcttctctc

SEQ ID NO: 63678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgccctggcaatcaccatt

SEQ ID NO: 63679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgccctggcaatcaccat

SEQ ID NO: 63680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatgccctggcaatcacca

SEQ ID NO: 63681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatcctttcatgccctggc

SEQ ID NO: 63682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccatcctttcatgccctg

SEQ ID NO: 63683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattctcccatcctttcatg

SEQ ID NO: 63684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccattctcccatcctttca

SEQ ID NO: 63685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatagcaattctccattctc

SEQ ID NO: 63686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccattgaatagcaattctcc

SEQ ID NO: 63687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcccattgaatagcaattc

SEQ ID NO: 63688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcccattgaatagcaatt

SEQ ID NO: 63689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcccattgaatagcaat

SEQ ID NO: 63690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaactttattcccattgaat

SEQ ID NO: 63691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataattgaaactttattcc

SEQ ID NO: 63692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcataattgaaactttattc

SEQ ID NO: 63693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttgcataattgaaactt

SEQ ID NO: 63694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatcttgcataattgaaa

SEQ ID NO: 63695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcatcttgcataattgaa

SEQ ID NO: 63696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaacttattcatcttgcata

SEQ ID NO: 63697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggaagtccctagaactta

SEQ ID NO: 63698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgaagtactacaggaagtcc

SEQ ID NO: 63699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagttacgaagtactacagg

SEQ ID NO: 63700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actatagttacgaagtacta

SEQ ID NO: 63701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaactatagttacgaagta

SEQ ID NO: 63702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatattgttaactatagt

SEQ ID NO: 63703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtatactatatatattgtt

SEQ ID NO: 63704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtatactatatatattgt

SEQ ID NO: 63705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtatactatatatattg

SEQ ID NO: 63706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtatactatatatatt

SEQ ID NO: 63707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaaatttttaagtatact

SEQ ID NO: 63708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacaaaatttttaagtatac

SEQ ID NO: 63709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttaacaaaatttttaagta

SEQ ID NO: 63710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgcttaacaaaattttta

SEQ ID NO: 63711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatgagatctacctgctta

SEQ ID NO: 63712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatatgagatctacctgctt

SEQ ID NO: 63713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtaaggaaacttaatatg

SEQ ID NO: 63714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtggtaaggaaacttaat

SEQ ID NO: 63715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattgtggtaaggaaact

SEQ ID NO: 63716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattattgtggtaaggaaac

SEQ ID NO: 63717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattattgtggtaaggaaa

SEQ ID NO: 63718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttaattattgtggtaag

SEQ ID NO: 63719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaattttaattattgtggt

SEQ ID NO: 63720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaattttaattattgtgg

SEQ ID NO: 63721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctaattttaattattgtg

SEQ ID NO: 63722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctttcctaattttaattat

SEQ ID NO: 63723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctttcctaattttaatta

SEQ ID NO: 63724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcctttcctaattttaatt

SEQ ID NO: 63725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgcctttcctaattttaa

SEQ ID NO: 63726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgcctttcctaatttta

SEQ ID NO: 63727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttgcctttcctaatttt

SEQ ID NO: 63728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctttgcctttcctaattt

SEQ ID NO: 63729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagaaaaaaaacaaatga

SEQ ID NO: 63730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccaaagaaaaaaaacaaa

SEQ ID NO: 63731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attccaaagaaaaaaaacaa

SEQ ID NO: 63732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttattccaaagaaaaaaa

SEQ ID NO: 63733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatgaactcatttattcca

SEQ ID NO: 63734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatgaactcatttattcc

SEQ ID NO: 63735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgatgaactcatttattc

SEQ ID NO: 63736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtagaagtacgtagtagat

SEQ ID NO: 63737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacatgctatgtagaagta

SEQ ID NO: 63738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaacacatgctatgtaga

SEQ ID NO: 63739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattagttaacacatgctat

SEQ ID NO: 63740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattagttaacacatgcta

SEQ ID NO: 63741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaaacatgaccaacactt

SEQ ID NO: 63742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgaaaaaacatgaccaac

SEQ ID NO: 63743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgaaaaaacatgaccaa

SEQ ID NO: 63744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccctgaaaaaacatgacc

SEQ ID NO: 63745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactcttccctgaaaaaaca

SEQ ID NO: 63746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactcttccctgaaaaaac

SEQ ID NO: 63747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccactcttccctgaaaaaa

SEQ ID NO: 63748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccactcttccctgaaaa

SEQ ID NO: 63749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttccactcttccctgaaa

SEQ ID NO: 63750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatttctttccactcttcc

SEQ ID NO: 63751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatttctttccactcttc

SEQ ID NO: 63752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgatttagaatttctttc

SEQ ID NO: 63753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaatgatttagaatttctt

SEQ ID NO: 63754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaatgatttagaatttct

SEQ ID NO: 63755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgaatgatttagaatttc

SEQ ID NO: 63756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgaatgatttagaattt

SEQ ID NO: 63757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accttttctgaatgatttag

SEQ ID NO: 63758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaccttttctgaatgattt

SEQ ID NO: 63759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaccttttctgaatgatt

SEQ ID NO: 63760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgaccttttctgaatgat

SEQ ID NO: 63761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctgaccttttctgaat

SEQ ID NO: 63762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttctgaccttttctgaa

SEQ ID NO: 63763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttctgaccttttctga

SEQ ID NO: 63764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattttctgaccttttctg

SEQ ID NO: 63765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtatagcttttattttctg

SEQ ID NO: 63766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatctaagtatagctttta

SEQ ID NO: 63767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaatctaagtatagctttt

SEQ ID NO: 63768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttgcaatctaagtatag

SEQ ID NO: 63769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcttgcaatctaagtata

SEQ ID NO: 63770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtatttcatcttgcaatc

SEQ ID NO: 63771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagtatttcatcttgcaat

SEQ ID NO: 63772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccagtatttcatcttgca

SEQ ID NO: 63773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcattcttccagtatttcat

SEQ ID NO: 63774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatcccctatcattcttcc

SEQ ID NO: 63775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagcatcaaaaactcatat

SEQ ID NO: 63776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaagcatcaaaaactcata

SEQ ID NO: 63777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttagaagcatcaaaaact

SEQ ID NO: 63778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatttagaagcatcaaaa

SEQ ID NO: 63779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaccaccaaagtcaggaaa

SEQ ID NO: 63780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atactatcaccaccaaagtc

SEQ ID NO: 63781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggaagtaaaataggatgg

SEQ ID NO: 63782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgcaggaagtaaaatagga

SEQ ID NO: 63783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactgcaggaagtaaaatag

SEQ ID NO: 63784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactgcaggaagtaaaata

SEQ ID NO: 63785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacatttctactgcaggaa

SEQ ID NO: 63786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaacatttctactgcagga

SEQ ID NO: 63787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacaacatttctactgcag

SEQ ID NO: 63788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttacaacatttctactg

SEQ ID NO: 63789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttattcttacaacattt

SEQ ID NO: 63790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgttattcttacaaca

SEQ ID NO: 63791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaatgttattcttacaac

SEQ ID NO: 63792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgttaatgttattcttac

SEQ ID NO: 63793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcttgttaatgttattct

SEQ ID NO: 63794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgcttgttaatgttattc

SEQ ID NO: 63795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttcctgcttgttaatgt

SEQ ID NO: 63796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcttcctgcttgttaatg

SEQ ID NO: 63797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcttcctgcttgttaat

SEQ ID NO: 63798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttaatcttcctgcttgt

SEQ ID NO: 63799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaagagcagtatgagcata

SEQ ID NO: 63800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcgtgtctagaaagagcag

SEQ ID NO: 63801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataggataaattaagcgtg

SEQ ID NO: 63802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgcataggataaattaag

SEQ ID NO: 63803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgcataggataaattaa

SEQ ID NO: 63804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtcttccctgcataggata

SEQ ID NO: 63805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcagtcttccctgcatagg

SEQ ID NO: 63806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatacatacatgtaatat

SEQ ID NO: 63807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcattatatatacatacat

SEQ ID NO: 63808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagcattatatatacataca

SEQ ID NO: 63809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacttaagcattatatatac

SEQ ID NO: 63810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacttaagcattatatat

SEQ ID NO: 63811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaacttaagcattatata

SEQ ID NO: 63812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaacttaagcattatat

SEQ ID NO: 63813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcaacttaagcattata

SEQ ID NO: 63814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttctcaacttaagcatt

SEQ ID NO: 63815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttctcaacttaagcat

SEQ ID NO: 63816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttatttttctcaactta

SEQ ID NO: 63817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatttatttttctcaactt

SEQ ID NO: 63818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatttatttttctcaact

SEQ ID NO: 63819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttcaatttatttttctc

SEQ ID NO: 63820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagtgtacactgattttc

SEQ ID NO: 63821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagtgtacactgatttt

SEQ ID NO: 63822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttataaagtgtacactg

SEQ ID NO: 63823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttataaagtgtacact

SEQ ID NO: 63824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatttataaagtgtacac

SEQ ID NO: 63825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattttacatttataaagtg

SEQ ID NO: 63826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttccattttacatttat

SEQ ID NO: 63827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgttccattttacattta

SEQ ID NO: 63828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttcatgttccattttac

SEQ ID NO: 63829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttcatgttccatttta

SEQ ID NO: 63830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatttcatgttccatttt

SEQ ID NO: 63831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatttcatgttccattt

SEQ ID NO: 63832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatttttaaatttcatgt

SEQ ID NO: 63833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagatttttaaatttcatg

SEQ ID NO: 63834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagatttttaaatttcat

SEQ ID NO: 63835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagatttttaaatttca

SEQ ID NO: 63836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaaagatttttaaatt

SEQ ID NO: 63837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttaaagatttttaaat

SEQ ID NO: 63838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatacagatgtttatttt

SEQ ID NO: 63839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaatacagatgtttattt

SEQ ID NO: 63840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acatttacaaatacagatgt

SEQ ID NO: 63841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctgacatttacaaataca

SEQ ID NO: 63842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcctgacatttacaaatac

SEQ ID NO: 63843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatcctgacatttacaaa

SEQ ID NO: 63844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattatttatcctgacattt

SEQ ID NO: 63845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaatattgcattatttat

SEQ ID NO: 63846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaaatattgcattattta

SEQ ID NO: 63847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagtagacaaaaatttagt

SEQ ID NO: 63848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaagtagacaaaaatttag

SEQ ID NO: 63849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgcaagtagacaaaaatt

SEQ ID NO: 63850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actatttgcaagtagacaaa

SEQ ID NO: 63851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtgcatgattgactattt

SEQ ID NO: 63852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaagacagatgtacatgta

SEQ ID NO: 63853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatctaagaagacagatgt

SEQ ID NO: 63854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcatctaagaagacagatg

SEQ ID NO: 63855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttagcatctaagaagaca

SEQ ID NO: 63856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtactggcttagcatctaa

SEQ ID NO: 63857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtactggcttagcatcta

SEQ ID NO: 63858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggtactggcttagcatct

SEQ ID NO: 63859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaagagaataataatttt

SEQ ID NO: 63860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatggtagaattacaaaaga

SEQ ID NO: 63861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagactaaatggtagaatta

SEQ ID NO: 63862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagactaaatggtagaatt

SEQ ID NO: 63863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggagactaaatggtagaat

SEQ ID NO: 63864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaaaaagagatctttgga

SEQ ID NO: 63865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtaccacctatacaaaaa

SEQ ID NO: 63866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttgtggtaccacctataca

SEQ ID NO: 63867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggttgtggtaccacctata

SEQ ID NO: 63868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatactctggttgtggtac

SEQ ID NO: 63869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgagatactctggttgtg

SEQ ID NO: 63870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaactaactgagatactct

SEQ ID NO: 63871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcaactaactgagatactc

SEQ ID NO: 63872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtcaactaactgagatac

SEQ ID NO: 63873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtcaactaactgagata

SEQ ID NO: 63874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtttcttgtcaactaact

SEQ ID NO: 63875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggagtttcttgtcaactaa

SEQ ID NO: 63876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attctggagtttcttgtcaa

SEQ ID NO: 63877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagagataaaggagtctaa

SEQ ID NO: 63878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaagagataaaggagtcta

SEQ ID NO: 63879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatttgcaagagataaagg

SEQ ID NO: 63880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgatttgcaagagataaag

SEQ ID NO: 63881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtgatttgcaagagata

SEQ ID NO: 63882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtattgcttgtgatttgc

SEQ ID NO: 63883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagggtagaatctacagtat

SEQ ID NO: 63884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagggtagaatctacagta

SEQ ID NO: 63885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagggtagaatctacagt

SEQ ID NO: 63886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacattttagagggtagaa

SEQ ID NO: 63887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattaaaacattttagaggg

SEQ ID NO: 63888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtcaatggagaatagga

SEQ ID NO: 63889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcctgtgtgtcaatggaga

SEQ ID NO: 63890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaattagtcctgtgtgtca

SEQ ID NO: 63891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtctccaaattagtcctgt

SEQ ID NO: 63892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccacactaagtctccaaa

SEQ ID NO: 63893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacctggaccacactaagt

SEQ ID NO: 63894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctgccacctggaccacac

SEQ ID NO: 63895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacctgccacctggaccaca

SEQ ID NO: 63896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgacctgccacctggacc

SEQ ID NO: 63897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaccctgcttgacctgcca

SEQ ID NO: 63898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaccctgcttgacctgcc

SEQ ID NO: 63899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcagaccctgcttgacct

SEQ ID NO: 63900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggaaggaccaaagactatt

SEQ ID NO: 63901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcagtgatgcacaaaatgac

SEQ ID NO: 63902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctagcagtgatgcacaaa

SEQ ID NO: 63903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaaattaatctagcagt

SEQ ID NO: 63904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaaaattaatctagcag

SEQ ID NO: 63905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaaaaaattaatctagca

SEQ ID NO: 63906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctttacaaaaaattaatc

SEQ ID NO: 63907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagactgagctttacaaaaa

SEQ ID NO: 63908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagagactgagctttacaaa

SEQ ID NO: 63909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagagactgagctttacaa

SEQ ID NO: 63910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctagagactgagctttaca

SEQ ID NO: 63911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctagagactgagctttac

SEQ ID NO: 63912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctagagactgagcttta

SEQ ID NO: 63913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttttctagagactgagct

SEQ ID NO: 63914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagaattgctttttctagag

SEQ ID NO: 63915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctccagaattgctttttct

SEQ ID NO: 63916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggatctagctccagaattg

SEQ ID NO: 63917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatggatctagctccaga

SEQ ID NO: 63918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattatggatctagctccag

SEQ ID NO: 63919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaagtagtttcattatgga

SEQ ID NO: 63920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagctaaaaagtagtttca

SEQ ID NO: 63921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacatggcctgacagctaaa

SEQ ID NO: 63922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacatggcctgacagctaa

SEQ ID NO: 63923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcacatggcctgacagc

SEQ ID NO: 63924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttgcacatggcctgacag

SEQ ID NO: 63925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttatttgcacatggcctg

SEQ ID NO: 63926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaaaattatcttatttgc

SEQ ID NO: 63927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagaaaaattatcttattt

SEQ ID NO: 63928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctctcagaaaaattatct

SEQ ID NO: 63929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctctcagaaaaattatc

SEQ ID NO: 63930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttaacctctcagaaaaat

SEQ ID NO: 63931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagacatagtatcctcatt

SEQ ID NO: 63932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacaaatctaaaagacata

SEQ ID NO: 63933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaacaaatctaaaagacat

SEQ ID NO: 63934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaacaaatctaaaagaca

SEQ ID NO: 63935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtcaaattttacaacaaa

SEQ ID NO: 63936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acataattgtagtcaaattt

SEQ ID NO: 63937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacataattgtagtcaaat

SEQ ID NO: 63938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaacataattgtagtcaaa

SEQ ID NO: 63939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtaaaatacttctaacata

SEQ ID NO: 63940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgatatgtcagatcctgt

SEQ ID NO: 63941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agactccatgatatgtcaga

SEQ ID NO: 63942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaagactccatgatatgtc

SEQ ID NO: 63943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaagactccatgatatgt

SEQ ID NO: 63944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtttattaagactccatg

SEQ ID NO: 63945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtagggaagaatatggaag

SEQ ID NO: 63946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatatgttgagtagggaag

SEQ ID NO: 63947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcatatatgttgagtagg

SEQ ID NO: 63948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcatatatgttgagtag

SEQ ID NO: 63949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtttcattcatatatgtt

SEQ ID NO: 63950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagcagctggtgtttcatt

SEQ ID NO: 63951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagcagctggtgtttcat

SEQ ID NO: 63952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatagcagctggtgtttca

SEQ ID NO: 63953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatagcagctggtgtttc

SEQ ID NO: 63954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatagcagctggtgttt

SEQ ID NO: 63955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaatagcagctggtgtt

SEQ ID NO: 63956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaccttttttaatagcagct

SEQ ID NO: 63957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagtagatataaaaagccg

SEQ ID NO: 63958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgagagtagatataaaaa

SEQ ID NO: 63959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctgcctgagagtagatat

SEQ ID NO: 63960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctgcctgagagtagata

SEQ ID NO: 63961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacctgcctgagagtagat

SEQ ID NO: 63962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaaatagtaaaagatgag

SEQ ID NO: 63963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagaaatagtaaaagatga

SEQ ID NO: 63964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatttggagaaatagtaaa

SEQ ID NO: 63965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagatttggagaaatagtaa

SEQ ID NO: 63966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaaatttaagatttggag

SEQ ID NO: 63967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagaaatttaagatttgga

SEQ ID NO: 63968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagaaatttaagatttgg

SEQ ID NO: 63969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggttttgaagaaatttaaga

SEQ ID NO: 63970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggttttgaagaaatttaag

SEQ ID NO: 63971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcggttttgaagaaatttaa

SEQ ID NO: 63972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggggggatagcaatgcttt

SEQ ID NO: 63973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaaagaggcagcaattca

SEQ ID NO: 63974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttgataaaagaggcagca

SEQ ID NO: 63975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acccacatggagtgaaacag

SEQ ID NO: 63976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaggtgggaaagaagacat

SEQ ID NO: 63977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaggtgggaaagaagaca

SEQ ID NO: 63978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaaggtgggaaagaagac

SEQ ID NO: 63979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaggctttggaaggtggg

SEQ ID NO: 63980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaatacgtgacaattgag

SEQ ID NO: 63981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaatacgtgacaattga

SEQ ID NO: 63982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaatggtttatgaaatac

SEQ ID NO: 63983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatagaatggtttatgaaa

SEQ ID NO: 63984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaagcacaaaaaatataca

SEQ ID NO: 63985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatcatgataaatacaata

SEQ ID NO: 63986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccccaaatactataatcat

SEQ ID NO: 63987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatccccaaatactataatc

SEQ ID NO: 63988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgctctatccccaaatacta

SEQ ID NO: 63989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatgctctatccccaaata

SEQ ID NO: 63990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactatgctctatccccaaa

SEQ ID NO: 63991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctactatgctctatcccca

SEQ ID NO: 63992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactctctactatgctctat

SEQ ID NO: 63993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaactctctactatgctc

SEQ ID NO: 63994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattaaactctctactatgc

SEQ ID NO: 63995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactctattaaactctctac

SEQ ID NO: 63996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtactctattaaactctcta

SEQ ID NO: 63997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatgtatcttgtactctatt

SEQ ID NO: 63998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatagagtcagtagtaaatt

SEQ ID NO: 63999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccaaggtcatatatcgagt

SEQ ID NO: 64000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acccaaggtcatatatcgag

SEQ ID NO: 64001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgacttacccaaggtcat

SEQ ID NO: 64002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaatgaggaaaggcacac

SEQ ID NO: 64003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaaatgaggaaaggcaca

SEQ ID NO: 64004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacaaatgaggaaaggcac

SEQ ID NO: 64005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcacaaatgaggaaaggc

SEQ ID NO: 64006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagagtctctttcacaaatg

SEQ ID NO: 64007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacagagtctctttcacaa

SEQ ID NO: 64008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggcacacaatccaacccat

SEQ ID NO: 64009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggcacacaatccaaccca

SEQ ID NO: 64010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagggcacacaatccaacc

SEQ ID NO: 64011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttagggcacacaatccaac

SEQ ID NO: 64012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtaccttcttagggcac

SEQ ID NO: 64013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatgtaccttcttagggca

SEQ ID NO: 64014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacttatatgtaccttctt

SEQ ID NO: 64015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agggttaggacttatatgta

SEQ ID NO: 64016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtgctaagggttaggact

SEQ ID NO: 64017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaagtgctaagggttagga

SEQ ID NO: 64018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaataaggtcacattctgaa

SEQ ID NO: 64019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaataaggtcacattctga

SEQ ID NO: 64020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaataaggtcacattctg

SEQ ID NO: 64021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcaaataaggtcacatt

SEQ ID NO: 64022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatgacattattttcaaat

SEQ ID NO: 64023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctgcaatgacattattt

SEQ ID NO: 64024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attacatctgcaatgacatt

SEQ ID NO: 64025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattacatctgcaatgacat

SEQ ID NO: 64026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttaattacatctgcaat

SEQ ID NO: 64027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcttaattacatctgcaa

SEQ ID NO: 64028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtatgacttcatcttaat

SEQ ID NO: 64029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cactccagtatgacttcatc

SEQ ID NO: 64030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagcccactccactccagt

SEQ ID NO: 64031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattaagagcccactccact

SEQ ID NO: 64032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaaggatgccagtcacact

SEQ ID NO: 64033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctagtaaggatgccagtcac

SEQ ID NO: 64034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactagtaaggatgccagtc

SEQ ID NO: 64035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctactagtaaggatgcca

SEQ ID NO: 64036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctctactagtaaggatgc

SEQ ID NO: 64037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctctactagtaaggatg

SEQ ID NO: 64038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcctctactagtaaggat

SEQ ID NO: 64039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtctttctcctctacta

SEQ ID NO: 64040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgtgtctttctcctctac

SEQ ID NO: 64041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctctgtgtgtctttctcct

SEQ ID NO: 64042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctctgtgtgtctttctcc

SEQ ID NO: 64043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctctgtgtgtctttctc

SEQ ID NO: 64044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtgacatgccattttccc

SEQ ID NO: 64045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattatagtgacatgccat

SEQ ID NO: 64046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcccattatagtgacatgcc

SEQ ID NO: 64047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatctctcccattatagtg

SEQ ID NO: 64048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggcaacagaactccaatct

SEQ ID NO: 64049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggcaacagaactccaatc

SEQ ID NO: 64050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttatggcaacagaactcc

SEQ ID NO: 64051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtttatggcaacagaactc

SEQ ID NO: 64052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggtttatggcaacagaac

SEQ ID NO: 64053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggtttatggcaacagaa

SEQ ID NO: 64054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtagcccaggtgtttcttgg

SEQ ID NO: 64055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtagcccaggtgtttctt

SEQ ID NO: 64056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggtagcccaggtgtttct

SEQ ID NO: 64057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcttctggtagcccaggt

SEQ ID NO: 64058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagcttctggtagcccagg

SEQ ID NO: 64059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccagcttctggtagccca

SEQ ID NO: 64060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcttccagcttctggtag

SEQ ID NO: 64061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcctcttccagcttctgg

SEQ ID NO: 64062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcctcttccagcttctg

SEQ ID NO: 64063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgcctcttccagcttct

SEQ ID NO: 64064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaaatatattttattgcc

SEQ ID NO: 64065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagaaaatatattttattg

SEQ ID NO: 64066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcctctaagaaaatatat

SEQ ID NO: 64067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcctctaagaaaatata

SEQ ID NO: 64068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagcctctaagaaaatat

SEQ ID NO: 64069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaagcctctaagaaaat

SEQ ID NO: 64070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttaaagcctctaagaaa

SEQ ID NO: 64071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagtgtcagcaggtccatg

SEQ ID NO: 64072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagtccaaattcaaagtgt

SEQ ID NO: 64073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggttagaagtccaaattc

SEQ ID NO: 64074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggttagaagtccaaatt

SEQ ID NO: 64075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaggttagaagtccaaat

SEQ ID NO: 64076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggaggttagaagtccaaa

SEQ ID NO: 64077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacttttggaggttagaag

SEQ ID NO: 64078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcacacttttggaggttaga

SEQ ID NO: 64079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcacacttttggaggtta

SEQ ID NO: 64080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaagagaaatatattct

SEQ ID NO: 64081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaacaagagaaatatattc

SEQ ID NO: 64082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggcttaaaacaagagaaa

SEQ ID NO: 64083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgagaacaggataatacaaa

SEQ ID NO: 64084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctacgagaacaggataat

SEQ ID NO: 64085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacctacgagaacaggataa

SEQ ID NO: 64086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacctacgagaacaggata

SEQ ID NO: 64087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgacctacgagaacagga

SEQ ID NO: 64088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgacctacgagaacagg

SEQ ID NO: 64089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttctttgacctacgagaa

SEQ ID NO: 64090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattagtttctttgacctac

SEQ ID NO: 64091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatcaactgtattagtttc

SEQ ID NO: 64092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatcaactgtattagttt

SEQ ID NO: 64093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttcacatcaactgtatt

SEQ ID NO: 64094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaatcttcacatcaactg

SEQ ID NO: 64095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaattaatcttcacatca

SEQ ID NO: 64096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaattaatcttcacatc

SEQ ID NO: 64097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattaattaatcttcacat

SEQ ID NO: 64098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattaattaatcttcaca

SEQ ID NO: 64099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatttttaattaattaatc

SEQ ID NO: 64100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaatttttaattaattaa

SEQ ID NO: 64101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaatttttaattaatta

SEQ ID NO: 64102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaatcttctgaaattttt

SEQ ID NO: 64103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcaatcttctgaaatttt

SEQ ID NO: 64104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatttgagcaatcttctga

SEQ ID NO: 64105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatactgtaatttgagcaat

SEQ ID NO: 64106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaatactgtaatttgagc

SEQ ID NO: 64107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgaatactgtaatttgag

SEQ ID NO: 64108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacttgttgaatactgtaa

SEQ ID NO: 64109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcatagcagaataaataa

SEQ ID NO: 64110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtcatagcagaataaata

SEQ ID NO: 64111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggagtttatgtcatagca

SEQ ID NO: 64112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctcaaggagtttatgtca

SEQ ID NO: 64113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgagctcaaggagtttatg

SEQ ID NO: 64114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggagaccaacgtaagatat

SEQ ID NO: 64115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggggagaccaacgtaagata

SEQ ID NO: 64116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagcttggggagaccaacgt

SEQ ID NO: 64117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttggagcttggggagacc

SEQ ID NO: 64118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaatatatattgggttgg

SEQ ID NO: 64119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtaatatatattgggttg

SEQ ID NO: 64120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtaatatatattgggtt

SEQ ID NO: 64121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtgtaatatatattgg

SEQ ID NO: 64122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgtgtaatatatattg

SEQ ID NO: 64123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttgtgtaatatatatt

SEQ ID NO: 64124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttattttgtgtaatatat

SEQ ID NO: 64125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttattttgtgtaatata

SEQ ID NO: 64126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattttattttgtgtaat

SEQ ID NO: 64127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtagttatttattttat

SEQ ID NO: 64128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagtagttatttatttta

SEQ ID NO: 64129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataagtagttatttatttt

SEQ ID NO: 64130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaacacattttataagtag

SEQ ID NO: 64131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaaaacacattttataag

SEQ ID NO: 64132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaaaacacattttataa

SEQ ID NO: 64133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttattcaaaacacatttta

SEQ ID NO: 64134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaaatcaatacactatt

SEQ ID NO: 64135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataattaagaaaaatcaat

SEQ ID NO: 64136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaggattgaataattaag

SEQ ID NO: 64137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatagaggattgaataatt

SEQ ID NO: 64138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatagaggattgaataat

SEQ ID NO: 64139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatgtttcctatagaggat

SEQ ID NO: 64140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatgtttcctatagagga

SEQ ID NO: 64141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaatgtttcctatagagg

SEQ ID NO: 64142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaatgtttcctatagag

SEQ ID NO: 64143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccaatgtttcctataga

SEQ ID NO: 64144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttttccaatgtttcctat

SEQ ID NO: 64145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttttccaatgtttcct

SEQ ID NO: 64146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctgttttttccaatgttt

SEQ ID NO: 64147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaatatatcaactattct

SEQ ID NO: 64148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcaatatatcaactattc

SEQ ID NO: 64149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagcaatatatcaactatt

SEQ ID NO: 64150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacccataggttttgagcaa

SEQ ID NO: 64151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttaaacccataggttttg

SEQ ID NO: 64152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggttaaacccataggtttt

SEQ ID NO: 64153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatttaggttaaacccata

SEQ ID NO: 64154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgatttaggttaaacccat

SEQ ID NO: 64155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttatgatttaggttaaac

SEQ ID NO: 64156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaacttatgatttaggtt

SEQ ID NO: 64157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggctaacttatgatttagg

SEQ ID NO: 64158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataataggttctggctaac

SEQ ID NO: 64159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaataataggttctggcta

SEQ ID NO: 64160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaataataggttctggct

SEQ ID NO: 64161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaataataggttctggc

SEQ ID NO: 64162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacagaaaacaattttctaa

SEQ ID NO: 64163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacagaaaacaattttcta

SEQ ID NO: 64164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcacagaaaacaattttct

SEQ ID NO: 64165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcacagaaaacaattttc

SEQ ID NO: 64166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttgcacagaaaacaat

SEQ ID NO: 64167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatttttgcacagaaaac

SEQ ID NO: 64168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcatttttgcacagaaaa

SEQ ID NO: 64169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttattcatttttgcaca

SEQ ID NO: 64170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatcttattcatttttgcac

SEQ ID NO: 64171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatatgcttaatcttatt

SEQ ID NO: 64172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatacaattacaaatatgc

SEQ ID NO: 64173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actagtatacaattacaaat

SEQ ID NO: 64174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaataattgactagtataca

SEQ ID NO: 64175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaataattgactagtatac

SEQ ID NO: 64176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaataattgactagtata

SEQ ID NO: 64177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaataattgactagtat

SEQ ID NO: 64178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcaaataattgactag

SEQ ID NO: 64179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttcaaataattgacta

SEQ ID NO: 64180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatttttcaaataattg

SEQ ID NO: 64181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttatttttcaaataatt

SEQ ID NO: 64182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaacttcatttatttttcaa

SEQ ID NO: 64183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagaacttcatttattttt

SEQ ID NO: 64184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagaacttcatttatttt

SEQ ID NO: 64185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattagaacttcatttattt

SEQ ID NO: 64186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttattagaacttcattt

SEQ ID NO: 64187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgattaattttattagaac

SEQ ID NO: 64188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatcaattcatgattaatt

SEQ ID NO: 64189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatcaattcatgattaat

SEQ ID NO: 64190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgatatcaattcatgat

SEQ ID NO: 64191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttgatatcaattcatga

SEQ ID NO: 64192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaaaagataatgtaaagt

SEQ ID NO: 64193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaaaagataatgtaaag

SEQ ID NO: 64194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaaaaaagataatgtaaa

SEQ ID NO: 64195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttccaaaaaagataatgt

SEQ ID NO: 64196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgaaagggatgaacaat

SEQ ID NO: 64197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtaatgaaagggatgaa

SEQ ID NO: 64198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgtaatgaaagggatga

SEQ ID NO: 64199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattgtaatgaaagggatg

SEQ ID NO: 64200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattgtaatgaaagggat

SEQ ID NO: 64201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatttttcattgtaatg

SEQ ID NO: 64202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatatttttcattgtaat

SEQ ID NO: 64203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccaacagaaaaagaagat

SEQ ID NO: 64204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaccaacagaaaaagaaga

SEQ ID NO: 64205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcatcatagataatttc

SEQ ID NO: 64206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggtgtcatcatagataa

SEQ ID NO: 64207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcattggtgtcatcataga

SEQ ID NO: 64208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcattggtgtcatcatag

SEQ ID NO: 64209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacttgttcattggtgtcat

SEQ ID NO: 64210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacttgttcattggtgtca

SEQ ID NO: 64211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaacttgttcattggtgtc

SEQ ID NO: 64212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttgaacttgttcattgg

SEQ ID NO: 64213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactttgaacttgttcattg

SEQ ID NO: 64214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcactttgaacttgttcat

SEQ ID NO: 64215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcattcttcactttgaac

SEQ ID NO: 64216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtcattcttcactttgaa

SEQ ID NO: 64217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggtcattcttcactttga

SEQ ID NO: 64218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatctttgggtcattcttc

SEQ ID NO: 64219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatctttgggtcattctt

SEQ ID NO: 64220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcatctttgggtcattct

SEQ ID NO: 64221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcgtctttatcatctttggg

SEQ ID NO: 64222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcgtctttatcatctttgg

SEQ ID NO: 64223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcgtctttatcatctttg

SEQ ID NO: 64224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtcgtctttatcatct

SEQ ID NO: 64225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgtcgtctttatcatc

SEQ ID NO: 64226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgtatatttattttgtcg

SEQ ID NO: 64227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacatgtatatttattttgt

SEQ ID NO: 64228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggtagacaagcagcccaa

SEQ ID NO: 64229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataggtagacaagcagccca

SEQ ID NO: 64230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataggtagacaagcagccc

SEQ ID NO: 64231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaattttataggtagacaa

SEQ ID NO: 64232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaattttataggtagaca

SEQ ID NO: 64233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaattttataggtagac

SEQ ID NO: 64234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtaaattttataggtaga

SEQ ID NO: 64235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttttgtaaattttatagg

SEQ ID NO: 64236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tccatataatgctaactttt

SEQ ID NO: 64237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtccatataatgctaact

SEQ ID NO: 64238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaaaccatgtgaaaaaga

SEQ ID NO: 64239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctggtcaaaccatgtgaaa

SEQ ID NO: 64240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattacctggtcaaaccatg

SEQ ID NO: 64241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattacctggtcaaaccat

SEQ ID NO: 64242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgaattacctggtcaaac

SEQ ID NO: 64243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatagcactgtttgaatta

SEQ ID NO: 64244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctaggatagcactgtttga

SEQ ID NO: 64245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctaggatagcactgtttg

SEQ ID NO: 64246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttacctaggatagcact

SEQ ID NO: 64247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcctatgtttacctagga

SEQ ID NO: 64248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatcctatgtttacctagg

SEQ ID NO: 64249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaatcctatgtttaccta

SEQ ID NO: 64250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaaatcctatgtttacct

SEQ ID NO: 64251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggcttcttaaatcctatgt

SEQ ID NO: 64252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacaatgctatggcttctta

SEQ ID NO: 64253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacctcaacaatgctatggc

SEQ ID NO: 64254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttaaacctcaacaatgct

SEQ ID NO: 64255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagtgattatgttaaacct

SEQ ID NO: 64256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaagagtgattatgttaaa

SEQ ID NO: 64257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataaattgttaagagtgat

SEQ ID NO: 64258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataataagtatgtaatgaa

SEQ ID NO: 64259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataagtatgtaataaatta

SEQ ID NO: 64260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacataagtatgtaataaa

SEQ ID NO: 64261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attacataagtatgtaataa

SEQ ID NO: 64262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattacataagtatgtaa

SEQ ID NO: 64263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatttattacataagta

SEQ ID NO: 64264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagattatattatttattac

SEQ ID NO: 64265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagattatattatttatta

SEQ ID NO: 64266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaagattatattattta

SEQ ID NO: 64267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttatttgaagattatat

SEQ ID NO: 64268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttatttgaagattata

SEQ ID NO: 64269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtagttatttgaagattat

SEQ ID NO: 64270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agccctttgtagttatttga

SEQ ID NO: 64271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaatatgagcacaaatatg

SEQ ID NO: 64272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaccaatatgagcacaaat

SEQ ID NO: 64273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaccaatatgagcacaaa

SEQ ID NO: 64274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctaccaatatgagcacaa

SEQ ID NO: 64275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttcctaccaatatgag

SEQ ID NO: 64276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaattttcctaccaatat

SEQ ID NO: 64277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttattgaattttcctacca

SEQ ID NO: 64278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttattgaattttcctacc

SEQ ID NO: 64279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaataacatatacatagta

SEQ ID NO: 64280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaataacatatacatagt

SEQ ID NO: 64281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaataacatatacatag

SEQ ID NO: 64282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggaaataacatatacata

SEQ ID NO: 64283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtacttttggaaataaca

SEQ ID NO: 64284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagtacttttggaaataac

SEQ ID NO: 64285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttacagtacttttggaaa

SEQ ID NO: 64286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggaatcaaaagaaaatacat

SEQ ID NO: 64287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaatataataaagatgta

SEQ ID NO: 64288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaatataataaagatgt

SEQ ID NO: 64289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaaatataataaagatg

SEQ ID NO: 64290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaaaatataataaagat

SEQ ID NO: 64291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtaatatttttacaaaata

SEQ ID NO: 64292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctaggtaatatttttacaa

SEQ ID NO: 64293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccctaggtaatattttta

SEQ ID NO: 64294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgattactccctaggtaat

SEQ ID NO: 64295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgattactccctaggtaa

SEQ ID NO: 64296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatgattactccctaggta

SEQ ID NO: 64297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaactttaatgattactc

SEQ ID NO: 64298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgctaagaaactttaatg

SEQ ID NO: 64299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgaaataagttccatgct

SEQ ID NO: 64300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgaaataagttccatgc

SEQ ID NO: 64301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgagtttatgtgaaataa

SEQ ID NO: 64302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatgagtttatgtgaaata

SEQ ID NO: 64303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaccttggatgagttta

SEQ ID NO: 64304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacaccttggatgagttt

SEQ ID NO: 64305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtttaaaacaccttggat

SEQ ID NO: 64306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagtttaaaacaccttgga

SEQ ID NO: 64307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagtttaaaacaccttgg

SEQ ID NO: 64308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacagtttaaaacaccttg

SEQ ID NO: 64309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttacagtttaaaacacc

SEQ ID NO: 64310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtttttacagtttaaaac

SEQ ID NO: 64311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtttttacagtttaaaa

SEQ ID NO: 64312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtttttacagtttaaa

SEQ ID NO: 64313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactgtttttacagtttaa

SEQ ID NO: 64314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtatagcttttactgttt

SEQ ID NO: 64315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtatagcttttactgtt

SEQ ID NO: 64316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgtatagcttttactgt

SEQ ID NO: 64317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaataaaaataaaataa

SEQ ID NO: 64318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcaaaataaaaataaaata

SEQ ID NO: 64319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtaaatatgcgcttatcaa

SEQ ID NO: 64320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgctcagtaaatatgcgc

SEQ ID NO: 64321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaatgctcagtaaatatg

SEQ ID NO: 64322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcattactaaatgctcagta

SEQ ID NO: 64323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgcaggctggcattactaa

SEQ ID NO: 64324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgcaggctggcattacta

SEQ ID NO: 64325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaggacccaacaagaaaat

SEQ ID NO: 64326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catagtgttgtgaggaccca

SEQ ID NO: 64327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctccatagtgttgtgaggac

SEQ ID NO: 64328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caatcatccaatgcctactc

SEQ ID NO: 64329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaatgtctacaatcatcc

SEQ ID NO: 64330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaataaatgtctacaatc

SEQ ID NO: 64331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctaataaatgtctacaat

SEQ ID NO: 64332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatttgtctaataaatgtc

SEQ ID NO: 64333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatctatcatttgtcta

SEQ ID NO: 64334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaatctatcatttgtct

SEQ ID NO: 64335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatttaatgaatctatcat

SEQ ID NO: 64336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctataatttaatgaatct

SEQ ID NO: 64337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaatctataatttaatga

SEQ ID NO: 64338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctaatctataatttaatg

SEQ ID NO: 64339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtctaatctataattta

SEQ ID NO: 64340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtctaatctataattt

SEQ ID NO: 64341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttatttgtctaatctata

SEQ ID NO: 64342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttatttgtctaatctat

SEQ ID NO: 64343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacttagtttatttgtcta

SEQ ID NO: 64344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagacttagtttatttgtct

SEQ ID NO: 64345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgagacttagtttatttgt

SEQ ID NO: 64346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgagacttagtttatttg

SEQ ID NO: 64347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttcttgagacttagttta

SEQ ID NO: 64348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accttcttgagacttagttt

SEQ ID NO: 64349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttaccttcttgagactta

SEQ ID NO: 64350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gggcaaattaccttaccttc

SEQ ID NO: 64351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgggcaaattaccttacctt

SEQ ID NO: 64352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttcgggcaaattacctta

SEQ ID NO: 64353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caactgacttcgggcaaatt

SEQ ID NO: 64354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacaactgacttcgggcaaa

SEQ ID NO: 64355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccatatcatccaagctct

SEQ ID NO: 64356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctgtaccatatcatccaag

SEQ ID NO: 64357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctgtaccatatcatcca

SEQ ID NO: 64358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattctagctgtaccatat

SEQ ID NO: 64359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcaaattctagctgtacc

SEQ ID NO: 64360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagatagagcctgattcaaa

SEQ ID NO: 64361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagtacagcagttggagat

SEQ ID NO: 64362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtggttgtgagtacagcagt

SEQ ID NO: 64363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atagtagcctagtggttgtg

SEQ ID NO: 64364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatagacaatgaagaacat

SEQ ID NO: 64365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggactcacatagacaatgaa

SEQ ID NO: 64366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggactcacatagacaatga

SEQ ID NO: 64367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaagcccttgggactcac

SEQ ID NO: 64368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgaagcccttgggactca

SEQ ID NO: 64369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taacttcatgaagcccttgg

SEQ ID NO: 64370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaactataacttcatgaag

SEQ ID NO: 64371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaactataacttcatgaa

SEQ ID NO: 64372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgatttccaaactataac

SEQ ID NO: 64373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgatttccaaactataa

SEQ ID NO: 64374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcagtgatttccaaacta

SEQ ID NO: 64375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcagtgatttccaaact

SEQ ID NO: 64376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttatttcagtgatttcca

SEQ ID NO: 64377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttatttcagtgatttcc

SEQ ID NO: 64378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtttatttcagtgattt

SEQ ID NO: 64379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttagtttatttcagtgatt

SEQ ID NO: 64380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagcttcttagtttatttc

SEQ ID NO: 64381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagcttcttagtttattt

SEQ ID NO: 64382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagcttcttagtttatt

SEQ ID NO: 64383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaagcttcttagtttat

SEQ ID NO: 64384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaaaagcttcttagtt

SEQ ID NO: 64385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttaaaagcttcttagt

SEQ ID NO: 64386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttttaaaagcttcttag

SEQ ID NO: 64387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactttatttttaaaagctt

SEQ ID NO: 64388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcactaaactttatttttaa

SEQ ID NO: 64389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcactaaactttattttta

SEQ ID NO: 64390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttagcactaaactttatt

SEQ ID NO: 64391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attatcttagcactaaactt

SEQ ID NO: 64392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtaagtattgattatctt

SEQ ID NO: 64393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaatgtaagtattgattat

SEQ ID NO: 64394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttaatgtaagtattgatt

SEQ ID NO: 64395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatgcagcagtggattct

SEQ ID NO: 64396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgtatgcagcagtggat

SEQ ID NO: 64397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggatggacgattattatg

SEQ ID NO: 64398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagggatggacgattattat

SEQ ID NO: 64399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagggatggacgattatta

SEQ ID NO: 64400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaagggatggacgattatt

SEQ ID NO: 64401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggcaacttttaagggatg

SEQ ID NO: 64402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaggcaacttttaagggat

SEQ ID NO: 64403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaaggcaacttttaaggg

SEQ ID NO: 64404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttaaaggcaacttttaa

SEQ ID NO: 64405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttattcttaaaggcaac

SEQ ID NO: 64406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatgttattcttaaaggc

SEQ ID NO: 64407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattaatgttattcttaaag

SEQ ID NO: 64408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattctattaatgttattc

SEQ ID NO: 64409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattcaaattctattaatg

SEQ ID NO: 64410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacattcaaattctattaat

SEQ ID NO: 64411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatatgagcttaacattca

SEQ ID NO: 64412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatatgagcttaacattc

SEQ ID NO: 64413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaatatgagcttaacatt

SEQ ID NO: 64414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttagaatatgagcttaac

SEQ ID NO: 64415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctattttagaatatgag

SEQ ID NO: 64416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggctattttagaatatga

SEQ ID NO: 64417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatggctattttagaata

SEQ ID NO: 64418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttatggctattttagaa

SEQ ID NO: 64419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagacaaaactctgttta

SEQ ID NO: 64420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtaacattaaacagacaa

SEQ ID NO: 64421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattgtggtaacattaaa

SEQ ID NO: 64422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataattgtggtaacattaa

SEQ ID NO: 64423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaataattgtggtaacat

SEQ ID NO: 64424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtattacttaataattgtgg

SEQ ID NO: 64425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagtattacttaataattg

SEQ ID NO: 64426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actagtattacttaataatt

SEQ ID NO: 64427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatacagcaaaacttactag

SEQ ID NO: 64428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatggacatgttgaatacag

SEQ ID NO: 64429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaaatggacatgttgaa

SEQ ID NO: 64430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattaaatggacatgttga

SEQ ID NO: 64431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacattaaatggacatgttg

SEQ ID NO: 64432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaatctttacattaaat

SEQ ID NO: 64433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaatctttacattaaa

SEQ ID NO: 64434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaaatctttacattaa

SEQ ID NO: 64435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaaatctttacatta

SEQ ID NO: 64436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaaaaaatctttacatt

SEQ ID NO: 64437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaatatgtcctttttaaaa

SEQ ID NO: 64438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaatatgtcctttttaaa

SEQ ID NO: 64439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgggaatatgtccttttt

SEQ ID NO: 64440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatgttacttgggaatatg

SEQ ID NO: 64441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatgttacttgggaatat

SEQ ID NO: 64442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agatttagaatgttacttgg

SEQ ID NO: 64443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactaagatttagaatgtt

SEQ ID NO: 64444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgggactaagatttagaa

SEQ ID NO: 64445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaataattaactgggacta

SEQ ID NO: 64446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaataattaactgggact

SEQ ID NO: 64447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taacaatttagaaataatta

SEQ ID NO: 64448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaggcaactgtaacaattt

SEQ ID NO: 64449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgcgaaattcacaggcaa

SEQ ID NO: 64450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaataaaaggttatgtgc

SEQ ID NO: 64451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaataaaaggttatgtg

SEQ ID NO: 64452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaaataaaaggttatgt

SEQ ID NO: 64453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctttaaaaaataaaaggt

SEQ ID NO: 64454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacctttaaaaaataaaagg

SEQ ID NO: 64455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcacctttaaaaaataaa

SEQ ID NO: 64456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttcacctttaaaaaataa

SEQ ID NO: 64457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttcacctttaaaaaata

SEQ ID NO: 64458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaaattttccttcacctt

SEQ ID NO: 64459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcataaaattttccttcac

SEQ ID NO: 64460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcataaaattttccttca

SEQ ID NO: 64461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttattcataaaattttcc

SEQ ID NO: 64462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtcttattcataaaattt

SEQ ID NO: 64463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtcttattcataaaatt

SEQ ID NO: 64464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaatggagaaaagatgtt

SEQ ID NO: 64465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaatggagaaaagatgt

SEQ ID NO: 64466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaaatggagaaaagatg

SEQ ID NO: 64467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacaggcatggagaaccct

SEQ ID NO: 64468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccacaggcatggagaaccc

SEQ ID NO: 64469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaagggatgagaggaactt

SEQ ID NO: 64470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acactatgaagggatgagag

SEQ ID NO: 64471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacactatgaagggatgaga

SEQ ID NO: 64472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttcacactatgaagggatg

SEQ ID NO: 64473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcttcacactatgaaggg

SEQ ID NO: 64474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgcttcacactatgaagg

SEQ ID NO: 64475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacttcctgcttcacactat

SEQ ID NO: 64476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacttcctgcttcacacta

SEQ ID NO: 64477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaacttcctgcttcacact

SEQ ID NO: 64478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaacttcctgcttcacac

SEQ ID NO: 64479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatgaacgtttttgaac

SEQ ID NO: 64480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaaatgaacgtttttgaa

SEQ ID NO: 64481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttcaaaaatgaacgttttt

SEQ ID NO: 64482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatattgcttcaaaaatga

SEQ ID NO: 64483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caccattcaaatattgcttc

SEQ ID NO: 64484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaccattcaaatattgctt

SEQ ID NO: 64485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatcttgcaccattcaaat

SEQ ID NO: 64486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcatgtggactcccatc

SEQ ID NO: 64487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtcatgtggactcccat

SEQ ID NO: 64488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtgtcatgtggactccca

SEQ ID NO: 64489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttggtgtcatgtggactcc

SEQ ID NO: 64490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actctttggtgtcatgtgga

SEQ ID NO: 64491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattgactctttggtgtca

SEQ ID NO: 64492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattgactctttggtgtc

SEQ ID NO: 64493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttataattgactctttgg

SEQ ID NO: 64494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatttataattgactctt

SEQ ID NO: 64495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttattaatttataattga

SEQ ID NO: 64496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttattaatttataattg

SEQ ID NO: 64497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttgagttattaatttat

SEQ ID NO: 64498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcatttgagttattaatt

SEQ ID NO: 64499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttgcatttgagttattaa

SEQ ID NO: 64500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgaataagaagcatgggt

SEQ ID NO: 64501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctacatgaataagaagcatg

SEQ ID NO: 64502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaacatgttcctacatgaat

SEQ ID NO: 64503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagaacatgttcctacatg

SEQ ID NO: 64504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctagaacatgttcctacat

SEQ ID NO: 64505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctagaacatgttcctaca

SEQ ID NO: 64506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtctttcctagaacatgttc

SEQ ID NO: 64507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaaaaaaaaaaaaaaa

SEQ ID NO: 64508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcaaaaaaaaaaaaaaaa

SEQ ID NO: 64509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctcaaaaaaaaaaaaaaa

SEQ ID NO: 64510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtctcaaaaaaaaaaaaa

SEQ ID NO: 64511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagagcgagactcttgtctc

SEQ ID NO: 64512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctacagagcgagactctt

SEQ ID NO: 64513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgggctacagagcga

SEQ ID NO: 64514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctgggctacag

SEQ ID NO: 64515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgggccaagatcgtgcc

SEQ ID NO: 64516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaggcggaggttgcagtgg

SEQ ID NO: 64517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaatcacgtgaa

SEQ ID NO: 64518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggctgaggcaggagaat

SEQ ID NO: 64519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaggctgaggcaggagaa

SEQ ID NO: 64520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgggaggctgaggcagga

SEQ ID NO: 64521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctgcttgggaggctgaggc

SEQ ID NO: 64522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcctagctgcttgggag

SEQ ID NO: 64523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgtggtggcaggcgcctg

SEQ ID NO: 64524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgggtgtggtggcaggcg

SEQ ID NO: 64525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaaaattagct

SEQ ID NO: 64526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaaaatta

SEQ ID NO: 64527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaatacaaaaaaat

SEQ ID NO: 64528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacatagtgaaacccca

SEQ ID NO: 64529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gagaccagtctggccaacat

SEQ ID NO: 64530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccaaggtgggcagat

SEQ ID NO: 64531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccaaggtgggcaga

SEQ ID NO: 64532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccaaggtgggcag

SEQ ID NO: 64533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttgggaggccaaggtgg

SEQ ID NO: 64534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactttgggaggccaaggtg

SEQ ID NO: 64535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcactttgggaggccaagg

SEQ ID NO: 64536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtctcttcactttgggag

SEQ ID NO: 64537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcctgtagtctcttcact

SEQ ID NO: 64538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccgggcgcagtggctcatg

SEQ ID NO: 64539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggccgggcgcagtggctcat

SEQ ID NO: 64540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacagtgccagtcttggcc

SEQ ID NO: 64541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacagtgccagtcttggc

SEQ ID NO: 64542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacagtgccagtcttgg

SEQ ID NO: 64543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaacagtgccagtcttg

SEQ ID NO: 64544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtggtttttaaaacagtgc

SEQ ID NO: 64545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagataaaatactgtgtggt

SEQ ID NO: 64546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaattgaagataaaatact

SEQ ID NO: 64547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attataaattgaagataaaa

SEQ ID NO: 64548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagtatattaattataaa

SEQ ID NO: 64549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatagtatattaattataa

SEQ ID NO: 64550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatagtatattaattata

SEQ ID NO: 64551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaatagtatattaatta

SEQ ID NO: 64552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctttaaatagtatattaa

SEQ ID NO: 64553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacgaaggatataagttatt

SEQ ID NO: 64554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagatattggacgaaggat

SEQ ID NO: 64555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagatattggacgaagga

SEQ ID NO: 64556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatagatattggacgaagg

SEQ ID NO: 64557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattttaatagatattgga

SEQ ID NO: 64558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtattttaatagatattgg

SEQ ID NO: 64559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgagtgcttggtattttaa

SEQ ID NO: 64560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgagtgcttggtatttta

SEQ ID NO: 64561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagtgtcccatttcatgag

SEQ ID NO: 64562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttgtaagtgtcccattt

SEQ ID NO: 64563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagttgtaagtgtcccatt

SEQ ID NO: 64564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttcaagttgtaagtgtccc

SEQ ID NO: 64565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttcaagttgtaagtgtc

SEQ ID NO: 64566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctctgcttcaagttgtaag

SEQ ID NO: 64567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctatctctgcttcaagttg

SEQ ID NO: 64568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttacctatctctgcttcaa

SEQ ID NO: 64569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttacctatctctgcttca

SEQ ID NO: 64570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatgtcggacttggttac

SEQ ID NO: 64571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataatgtcggacttggtta

SEQ ID NO: 64572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgataatgtcggacttggtt

SEQ ID NO: 64573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagtgaactttgataatgt

SEQ ID NO: 64574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcaaaatgtgcgatggaaa

SEQ ID NO: 64575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaatgttagtcaaaatgtg

SEQ ID NO: 64576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgaatgttagtcaaaatgt

SEQ ID NO: 64577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccttatgaatgttagtcaa

SEQ ID NO: 64578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccttatgaatgttagtca

SEQ ID NO: 64579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcccttatgaatgttagtc

SEQ ID NO: 64580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgaatgttttgcccttatga

SEQ ID NO: 64581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaatcgttccgaatgtttt

SEQ ID NO: 64582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagtcaagttccaaatcgt

SEQ ID NO: 64583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcaagtcaagttccaaat

SEQ ID NO: 64584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgcaagtcaagttccaaa

SEQ ID NO: 64585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaccacagatgggtcacgg

SEQ ID NO: 64586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagtgtattaacaccacag

SEQ ID NO: 64587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgagtgtattaacaccac

SEQ ID NO: 64588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaagttctatgagtgtatt

SEQ ID NO: 64589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggcaagttctatgagtgt

SEQ ID NO: 64590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctggcaagttctatgagtg

SEQ ID NO: 64591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgctggcaagttctatga

SEQ ID NO: 64592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgctggcaagttctatg

SEQ ID NO: 64593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatcatgggagtaaattt

SEQ ID NO: 64594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattcagcatcatgggagt

SEQ ID NO: 64595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgatattcagcatcatgg

SEQ ID NO: 64596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggctgatattcagcatcat

SEQ ID NO: 64597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattctggctgatattcagc

SEQ ID NO: 64598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atattctggctgatattcag

SEQ ID NO: 64599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtcttatattctggctg

SEQ ID NO: 64600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtgtcttatattctggct

SEQ ID NO: 64601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgtgtgtcttatattctg

SEQ ID NO: 64602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcatgaatgtgctacttg

SEQ ID NO: 64603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatcatgaatgtgctactt

SEQ ID NO: 64604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccatcatgaatgtgcta

SEQ ID NO: 64605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataggagcaattccttccat

SEQ ID NO: 64606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatgcactcataggagca

SEQ ID NO: 64607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtcgttgtgaatgcactca

SEQ ID NO: 64608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatactaggtcgttgtgaat

SEQ ID NO: 64609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatactaggtcgttgtgaa

SEQ ID NO: 64610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatactaggtcgttgtga

SEQ ID NO: 64611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaatactaggtcgttgtg

SEQ ID NO: 64612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgaatactaggtcgttg

SEQ ID NO: 64613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgaatactaggtcgtt

SEQ ID NO: 64614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttttgaatactaggtcgt

SEQ ID NO: 64615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttttgaatactaggtc

SEQ ID NO: 64616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcttttgaatactaggt

SEQ ID NO: 64617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcttttgaatactagg

SEQ ID NO: 64618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctttcttttgaatactag

SEQ ID NO: 64619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcatgcttttctttctttt

SEQ ID NO: 64620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctaatcatgcttttctt

SEQ ID NO: 64621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaatcctaatcatgctttt

SEQ ID NO: 64622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actaatcctaatcatgcttt

SEQ ID NO: 64623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatcttactaatcctaatc

SEQ ID NO: 64624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatcttactaatcctaat

SEQ ID NO: 64625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaacatcttactaatcct

SEQ ID NO: 64626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctatttaacatcttactaa

SEQ ID NO: 64627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttgcctatttaacatct

SEQ ID NO: 64628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgttgcctatttaacatc

SEQ ID NO: 64629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatgttgcctatttaacat

SEQ ID NO: 64630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatgttgcctatttaac

SEQ ID NO: 64631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcatgttgcctatttaa

SEQ ID NO: 64632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catggcatttctttcatgtt

SEQ ID NO: 64633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtctgcatggcatttcttt

SEQ ID NO: 64634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtctgcatggcatttctt

SEQ ID NO: 64635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatgtctgcatggcattt

SEQ ID NO: 64636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatgtctgcatggcatt

SEQ ID NO: 64637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttatttatgtctgcatgg

SEQ ID NO: 64638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttatttatgtctgcat

SEQ ID NO: 64639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatttatttatgtctgca

SEQ ID NO: 64640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaatttatttatgtctgc

SEQ ID NO: 64641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctaatttatttatgtctg

SEQ ID NO: 64642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggcggcttttctaattta

SEQ ID NO: 64643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagggcggcttttctaattt

SEQ ID NO: 64644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatatttaagggcggctttt

SEQ ID NO: 64645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatatttaagggcggcttt

SEQ ID NO: 64646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtcttagatatttaaggg

SEQ ID NO: 64647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgtcttagatatttaagg

SEQ ID NO: 64648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttgatgtcttagatattt

SEQ ID NO: 64649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttggtttgatgtcttagat

SEQ ID NO: 64650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaacatgagtcggctggt

SEQ ID NO: 64651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaacatgagtcggctgg

SEQ ID NO: 64652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtgtagagtaggcatttaa

SEQ ID NO: 64653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgagtgtagagtaggcatt

SEQ ID NO: 64654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacactgctgagtgtagag

SEQ ID NO: 64655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcacactgctgagtgtaga

SEQ ID NO: 64656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttggcacactgctgagtgt

SEQ ID NO: 64657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttggcacactgctgagtg

SEQ ID NO: 64658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttgcttggcacactgctg

SEQ ID NO: 64659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttgcttggcacactgct

SEQ ID NO: 64660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttgcttggcacactgc

SEQ ID NO: 64661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtcttgcttggcacac

SEQ ID NO: 64662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttgtcttgcttggcaca

SEQ ID NO: 64663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtcttattttgtcttgct

SEQ ID NO: 64664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgatcacagagttcatgtc

SEQ ID NO: 64665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagcctggtgatcacagag

SEQ ID NO: 64666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagcctggtgatcacaga

SEQ ID NO: 64667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgataatcatgtaatttg

SEQ ID NO: 64668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgtgataatcatgtaat

SEQ ID NO: 64669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtgtgataatcatgtaa

SEQ ID NO: 64670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtgtgataatcatgta

SEQ ID NO: 64671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaattttattgtgtgataa

SEQ ID NO: 64672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaacaattttattgtgtga

SEQ ID NO: 64673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaacaattttattgtgtg

SEQ ID NO: 64674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctaacaattttattgtgt

SEQ ID NO: 64675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttgctaacaattttat

SEQ ID NO: 64676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atattttgctaacaatttta

SEQ ID NO: 64677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttatattttgctaacaat

SEQ ID NO: 64678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttatattttgctaacaa

SEQ ID NO: 64679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttatattttgctaaca

SEQ ID NO: 64680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtcttatattttgcta

SEQ ID NO: 64681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttattttgtcttatatttt

SEQ ID NO: 64682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttattttgtcttatattt

SEQ ID NO: 64683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttagttattttgtcttat

SEQ ID NO: 64684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatcttagttattttgt

SEQ ID NO: 64685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatattatcttagttattt

SEQ ID NO: 64686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctattatattatcttagt

SEQ ID NO: 64687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctattatattatcttag

SEQ ID NO: 64688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaagctattatattatct

SEQ ID NO: 64689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaagctattatattatc

SEQ ID NO: 64690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttatttaagctattata

SEQ ID NO: 64691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttatttaagctattat

SEQ ID NO: 64692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatttatttaagctatta

SEQ ID NO: 64693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttacatttatttaagcta

SEQ ID NO: 64694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttacatttatttaagct

SEQ ID NO: 64695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattttacatttatttaa

SEQ ID NO: 64696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttattttacatttattta

SEQ ID NO: 64697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttattttacatttattt

SEQ ID NO: 64698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttattttacatttatt

SEQ ID NO: 64699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttatttattttacattt

SEQ ID NO: 64700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttttatttattttaca

SEQ ID NO: 64701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatttttatttattttac

SEQ ID NO: 64702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttattatttttatttatt

SEQ ID NO: 64703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttattatttttatttat

SEQ ID NO: 64704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtttattatttttattta

SEQ ID NO: 64705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaataacaggttttggttt

SEQ ID NO: 64706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcaataacaggttttggtt

SEQ ID NO: 64707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttatcaataacaggtttt

SEQ ID NO: 64708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accttatcaataacaggttt

SEQ ID NO: 64709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtttaccttatcaataa

SEQ ID NO: 64710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaagtttaccttatcaata

SEQ ID NO: 64711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaagtttaccttatcaat

SEQ ID NO: 64712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagtgtacagattttaca

SEQ ID NO: 64713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagagtgtacagattttac

SEQ ID NO: 64714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagagtgtacagatttta

SEQ ID NO: 64715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccagagtgtacagatttt

SEQ ID NO: 64716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccagagtgtacagattt

SEQ ID NO: 64717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttccagagtgtacagatt

SEQ ID NO: 64718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttccagagtgtacagat

SEQ ID NO: 64719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttccagagtgtacaga

SEQ ID NO: 64720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttttccagagtgtaca

SEQ ID NO: 64721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttttccagagtgtac

SEQ ID NO: 64722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatttcttttttttccag

SEQ ID NO: 64723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacatttcttttttttcca

SEQ ID NO: 64724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttatacatttctttttt

SEQ ID NO: 64725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttatacatttcttttt

SEQ ID NO: 64726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatgtttatacatttct

SEQ ID NO: 64727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttatgtttatacatttc

SEQ ID NO: 64728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttatgtttatacattt

SEQ ID NO: 64729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatttatgtttatacatt

SEQ ID NO: 64730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtatataaatatatatt

SEQ ID NO: 64731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtatataaatatatat

SEQ ID NO: 64732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaataataggatcatgaac

SEQ ID NO: 64733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgctggtaataataggatc

SEQ ID NO: 64734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgctggtaataataggat

SEQ ID NO: 64735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatgctggtaataatagga

SEQ ID NO: 64736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgggggaatctttaatgctg

SEQ ID NO: 64737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgggggaatctttaatgc

SEQ ID NO: 64738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatgggggaatctttaat

SEQ ID NO: 64739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctatgggggaatctttaa

SEQ ID NO: 64740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatacaccaatagtttctc

SEQ ID NO: 64741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgatatacaccaatagtt

SEQ ID NO: 64742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacctacctgatatacacca

SEQ ID NO: 64743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgatgtccagtcataat

SEQ ID NO: 64744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaaatgatgtccagtc

SEQ ID NO: 64745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaattaaaatgatgtc

SEQ ID NO: 64746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaagagaataagaaaa

SEQ ID NO: 64747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggagaatgtctcaaaaaaa

SEQ ID NO: 64748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggagaatgtctcaaaaaa

SEQ ID NO: 64749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggagaatgtctcaaaaa

SEQ ID NO: 64750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtggagaatgtctcaaaa

SEQ ID NO: 64751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatccttttgtggagaatgt

SEQ ID NO: 64752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaatccttttgtggagaat

SEQ ID NO: 64753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagattctcaatccttttgt

SEQ ID NO: 64754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagattctcaatccttttg

SEQ ID NO: 64755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccatttaaagattctcaa

SEQ ID NO: 64756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaccatttaaagattctca

SEQ ID NO: 64757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggatttaaaccatttaaa

SEQ ID NO: 64758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtagaaccagccaaatctaa

SEQ ID NO: 64759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtagaaccagccaaatcta

SEQ ID NO: 64760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcgtagaaccagccaaat

SEQ ID NO: 64761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttcgtagaaccagccaaa

SEQ ID NO: 64762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatttcgtagaaccagcca

SEQ ID NO: 64763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcttatttcgtagaaccag

SEQ ID NO: 64764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacgattgctcttatttcg

SEQ ID NO: 64765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacgattgctcttatttc

SEQ ID NO: 64766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtaataataataaattta

SEQ ID NO: 64767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtaataataataaattt

SEQ ID NO: 64768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catataaagtatttagagta

SEQ ID NO: 64769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatataaagtatttagagt

SEQ ID NO: 64770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcaaaggcttacatataaa

SEQ ID NO: 64771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcaaaggcttacatataa

SEQ ID NO: 64772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatttagtcaaaggct

SEQ ID NO: 64773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggccagcactatatatatt

SEQ ID NO: 64774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgaggccagcactatata

SEQ ID NO: 64775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactgaggccagcactatat

SEQ ID NO: 64776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttaactgaggccagcact

SEQ ID NO: 64777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttaactgaggccagcac

SEQ ID NO: 64778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttaactgaggccagca

SEQ ID NO: 64779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtcttaactgaggccagc

SEQ ID NO: 64780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttgtcttaactgaggc

SEQ ID NO: 64781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaatttttgtcttaactga

SEQ ID NO: 64782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcctaatttttgtcttaac

SEQ ID NO: 64783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaaaactgttcctaatt

SEQ ID NO: 64784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaagcagaaataaagaaag

SEQ ID NO: 64785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgatcaatagcagtacaaa

SEQ ID NO: 64786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtggcaaagacaaactgg

SEQ ID NO: 64787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatgaaaactggagtggcaa

SEQ ID NO: 64788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctggatgaaaactggagt

SEQ ID NO: 64789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgccacaggaattgccct

SEQ ID NO: 64790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagagtgttaaatgccacag

SEQ ID NO: 64791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaaataagaaaatctgga

SEQ ID NO: 64792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagattaagtaaataagaa

SEQ ID NO: 64793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagattaagtaaataaga

SEQ ID NO: 64794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagattaagtaaataag

SEQ ID NO: 64795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtgtaagatgacaggtag

SEQ ID NO: 64796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagctgaagtgtaagatgac

SEQ ID NO: 64797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgggtgctcaagctgaag

SEQ ID NO: 64798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatgggtgctcaagctgaa

SEQ ID NO: 64799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttgaatgggtgctcaag

SEQ ID NO: 64800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttgaatgggtgctcaa

SEQ ID NO: 64801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacatttgtacttgaatgg

SEQ ID NO: 64802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacacatttgtacttgaatg

SEQ ID NO: 64803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacacatttgtacttgaat

SEQ ID NO: 64804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctttaacacatttgtact

SEQ ID NO: 64805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaggttaatctttaacaca

SEQ ID NO: 64806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctaacaggttaatctttaa

SEQ ID NO: 64807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctaacaggttaatcttta

SEQ ID NO: 64808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttccctaacaggttaatct

SEQ ID NO: 64809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaaaagaaggatcccagt

SEQ ID NO: 64810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacattgcagaaaagaagg

SEQ ID NO: 64811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatacattgcagaaaagaag

SEQ ID NO: 64812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttaatacattgcagaaaag

SEQ ID NO: 64813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaacctgcttaatacattg

SEQ ID NO: 64814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaacctgcttaatacatt

SEQ ID NO: 64815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcatcttgagaacctgct

SEQ ID NO: 64816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcatcttgagaacctgc

SEQ ID NO: 64817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagcatcttgagaacctg

SEQ ID NO: 64818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaaagcatcttgagaac

SEQ ID NO: 64819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattttaaagcatcttgaga

SEQ ID NO: 64820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctattttaaagcatcttga

SEQ ID NO: 64821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctattttaaagcatcttg

SEQ ID NO: 64822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatttctctattttaaagc

SEQ ID NO: 64823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtatttctctattttaaag

SEQ ID NO: 64824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagtcagagatccttagta

SEQ ID NO: 64825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attagtagtcagagatcctt

SEQ ID NO: 64826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatgatctgattagtagtca

SEQ ID NO: 64827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctagatgatctgattagta

SEQ ID NO: 64828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccctagatgatctgattag

SEQ ID NO: 64829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccctagatgatctgatta

SEQ ID NO: 64830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaccttctccctagatga

SEQ ID NO: 64831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaccttctccctagatg

SEQ ID NO: 64832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaatgtttgcaaacctt

SEQ ID NO: 64833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaaaatgtttgcaaacct

SEQ ID NO: 64834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatatttataaaaatgtt

SEQ ID NO: 64835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacggagatataacccaca

SEQ ID NO: 64836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatagttgcaacggagatat

SEQ ID NO: 64837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatggcagagttgaatagt

SEQ ID NO: 64838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatgacccatgactacca

SEQ ID NO: 64839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatgacccatgactacc

SEQ ID NO: 64840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatgtatgacccatgact

SEQ ID NO: 64841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttatgtatgacccatgac

SEQ ID NO: 64842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacacagccataccagttt

SEQ ID NO: 64843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaacacagccataccagtt

SEQ ID NO: 64844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggaacacagccataccag

SEQ ID NO: 64845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaaatgttcttggaacac

SEQ ID NO: 64846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaaaatgttcttggaaca

SEQ ID NO: 64847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaaaatgttcttggaac

SEQ ID NO: 64848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaaaaatgttcttggaa

SEQ ID NO: 64849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttgtaaaaatgttcttg

SEQ ID NO: 64850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccaaaggtcaacaaaccc

SEQ ID NO: 64851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggaccaaaggtcaacaaac

SEQ ID NO: 64852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctggaccaaaggtcaaca

SEQ ID NO: 64853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaataatcattgctctgga

SEQ ID NO: 64854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtccatgaactccaaat

SEQ ID NO: 64855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacaggtccatgaactccaa

SEQ ID NO: 64856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcccccaggaaacctcta

SEQ ID NO: 64857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgcccccaggaaacctct

SEQ ID NO: 64858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataatttcatgcccccagg

SEQ ID NO: 64859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatataatttcatgccccc

SEQ ID NO: 64860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatataatttcatgcccc

SEQ ID NO: 64861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cggaaagacagcacaaccat

SEQ ID NO: 64862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccggaaagacagcacaacca

SEQ ID NO: 64863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccggaaagacagcacaacc

SEQ ID NO: 64864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttccggaaagacagcac

SEQ ID NO: 64865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattgtctttccggaaaga

SEQ ID NO: 64866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaaagttagaattgtctt

SEQ ID NO: 64867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagaatctgatgaaagtta

SEQ ID NO: 64868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtcacatagactgtaaga

SEQ ID NO: 64869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggtcacatagactgtaag

SEQ ID NO: 64870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggtcacatagactgtaa

SEQ ID NO: 64871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaggtcacatagactgta

SEQ ID NO: 64872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaggtcacatagactgt

SEQ ID NO: 64873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttgaggtcacatagactg

SEQ ID NO: 64874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcttttttgaggtcacata

SEQ ID NO: 64875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaatcttttttgaggtcac

SEQ ID NO: 64876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcctaatcttttttgaggt

SEQ ID NO: 64877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcctcctaatcttttttga

SEQ ID NO: 64878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattcctcctaatcttttt

SEQ ID NO: 64879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcctattcctcctaatctt

SEQ ID NO: 64880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattcctattcctcctaatc

SEQ ID NO: 64881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctattcctattcctcctaa

SEQ ID NO: 64882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctctattcctattcctc

SEQ ID NO: 64883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattctctattcctattcct

SEQ ID NO: 64884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacttcattctctattccta

SEQ ID NO: 64885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacttcattctctattcct

SEQ ID NO: 64886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaacttcattctctattcc

SEQ ID NO: 64887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttgaacttcattctctat

SEQ ID NO: 64888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctactttgaacttcattct

SEQ ID NO: 64889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagctggctactttgaact

SEQ ID NO: 64890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaagagctggctactttga

SEQ ID NO: 64891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattaagagctggctacttt

SEQ ID NO: 64892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cgtgataaacatagtaggga

SEQ ID NO: 64893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatgtatcagagtgcctacg

SEQ ID NO: 64894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcagtgactagatgtatca

SEQ ID NO: 64895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtcagtgactagatgtatc

SEQ ID NO: 64896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaaggtgtgcttggtcag

SEQ ID NO: 64897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggcagtgataccacatgg

SEQ ID NO: 64898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagagtaagccccaaatcat

SEQ ID NO: 64899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgactgaagagtaagcccc

SEQ ID NO: 64900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgactgaagagtaagccc

SEQ ID NO: 64901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agacatttcatgactgaaga

SEQ ID NO: 64902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagacatttcatgactgaag

SEQ ID NO: 64903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaagacatcacaaggaggt

SEQ ID NO: 64904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccggggaagtctgggaaga

SEQ ID NO: 64905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagagagacagacaagggc

SEQ ID NO: 64906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatataaaaaacacagagt
